(12) United States Patent
Xiong et al.

(10) Patent No.: US 9,862,752 B2
(45) Date of Patent: Jan. 9, 2018

(54) GROWTH DIFFERENTIATION FACTOR 15 (GDF-15) CONSTRUCTS

(71) Applicant: Amgen Inc., Thousand Oaks, CA (US)

(72) Inventors: Yumei Xiong, Palo Alto, CA (US); Yi Zhang, Dublin, CA (US); Jackie Z. Sheng, Thousand Oaks, CA (US); Agnes Eva Hamburger, Newbury Park, CA (US); Murielle Veniant-Ellison, Thousand Oaks, CA (US); Grant Shimamoto, Westlake Village, CA (US); Xiaoshan Min, Burlingame, CA (US); Zhulun Wang, Palo Alto, CA (US); Jie Tang, Palo Alto, CA (US); Gunasekaran Kannan, Daly City, CA (US); Marissa Mock, Newbury Park, CA (US); Kenneth Walker, Newbury Park, CA (US)

(73) Assignee: Amgen Inc., Thousand Oaks, CA (US)

( * ) Notice: Subject to any disclaimer, the term of this patent is extended or adjusted under 35 U.S.C. 154(b) by 0 days.

(21) Appl. No.: 14/908,459

(22) PCT Filed: Jul. 31, 2014

(86) PCT No.: PCT/US2014/049254
§ 371 (c)(1),
(2) Date: Jan. 28, 2016

(87) PCT Pub. No.: WO2015/017710
PCT Pub. Date: Feb. 5, 2015

(65) Prior Publication Data
US 2016/0168213 A1 Jun. 16, 2016

Related U.S. Application Data

(60) Provisional application No. 61/860,723, filed on Jul. 31, 2013.

(51) Int. Cl.
*C07K 14/00* (2006.01)
*C07K 14/475* (2006.01)

(52) U.S. Cl.
CPC ........ *C07K 14/475* (2013.01); *C07K 2319/30* (2013.01)

(58) Field of Classification Search
None
See application file for complete search history.

(56) References Cited

U.S. PATENT DOCUMENTS

| 3,773,919 A | 11/1973 | Du Pont |
| 6,737,056 B1 | 5/2004 | Presta |
| 8,362,210 B2 | 1/2013 | Lazar et al. |
| 9,248,181 B2 * | 2/2016 | De Kruif |
| 9,550,819 B2 * | 1/2017 | Lindhout ............... A61K 45/06 |
| 2004/0053366 A1 * | 3/2004 | Lo ..................... C07K 14/5759 435/69.1 |
| 2010/0278843 A1 | 11/2010 | Breit et al. |
| 2011/0195067 A1 | 8/2011 | Arnason et al. |
| 2011/0229472 A1 | 9/2011 | Min et al. |
| 2011/0236375 A1 | 9/2011 | Lazar et al. |
| 2013/0336981 A1 * | 12/2013 | de Kruif ............... C07K 16/12 424/136.1 |
| 2015/0023960 A1 * | 1/2015 | Lindhout ............... A61K 45/06 424/134.1 |
| 2015/0139996 A1 * | 5/2015 | De Kruif ............... C07K 16/12 424/136.1 |

FOREIGN PATENT DOCUMENTS

| EP | 0036676 B2 | 9/1981 |
| EP | 0058481 A1 | 8/1982 |
| EP | 0088046 A2 | 9/1983 |
| EP | 0133988 A2 | 3/1985 |
| EP | 0143949 A1 | 6/1985 |
| EP | 2330197 A2 | 6/2011 |
| EP | 2439535 | 4/2012 |
| WO | 93/15722 A1 | 8/1993 |
| WO | 99/06445 A1 | 2/1999 |
| WO | 2005/077981 A2 | 8/2005 |
| WO | 2006/000448 A2 | 1/2006 |
| WO | 2007/041635 A2 | 4/2007 |
| WO | 2009/141357 | 11/2009 |
| WO | 2010/048670 A1 | 5/2010 |
| WO | 2011/064758 A2 | 6/2011 |
| WO | 2012/025355 | 3/2012 |
| WO | 2012/138919 A1 | 10/2012 |
| WO | 2013/113008 A1 | 8/2013 |
| WO | 2013/148117 A1 | 10/2013 |
| WO | WO 2013/157953 | * 10/2013 |

(Continued)

OTHER PUBLICATIONS

Sino Biological Inc. (http://www.sinobiological.com/GDF-15-Protein-g-570.html; available May 1, 2010.*

(Continued)

*Primary Examiner* — Elizabeth C Kemmerer

(57) ABSTRACT

Constructs comprising GDF15, and mutants thereof are provided. In various embodiments the constructs comprising GDF15, and mutants thereof, can be of use in the treatment or ameliorating a metabolic disorder. In various embodiments the metabolic disease or disorder is type 2 diabetes, obesity, dyslipidemia, elevated glucose levels, elevated insulin levels and diabetic nephropathy.

27 Claims, 61 Drawing Sheets

(56) References Cited

FOREIGN PATENT DOCUMENTS

| WO | WO 2013/157954 | * | 10/2013 |
|----|----------------|---|---------|
| WO | 2014/100689 A1 |   | 6/2014  |

OTHER PUBLICATIONS

Beck & Reichert, MABS, 2011, 3:5, 415-416.
Diabetes Care, vol. 33, Supplement 1, Jan. 2010.
Baek SJ et al., 2001, J Biol Chem. 276: 33384-33392.
Baek SJ et al., 2006, Gastroenterology. 131:1553-1560.
Bauskin et al., AR 2000, EMBO J. 19:2212-2220.
Berge et al., J. Pharm. Sci., vol. 66, No. 1, Jan. 3, 1997.
Bootcov MR et al., 1997, Proc. Natl. Acad. Sci. USA, vol. 94, pp. 11514-11519.
Bottner M et al., 1999, Gene. 237:105-111.
Carrillo & Lipman, SIAM J. Applied Math., 1988, 48:1073-1082.
Cekanova M et al., 2009, Cancer Prev Res 2:450-8.
Czajkowsky, et al., EMBO Mol Med, Epub, 2012 4(10), 1015-1028.
Dayhoff et al., Atlas of Protein Sequence and Structure, 1978, 5:345-352.
Devereux et al., Nucl. Acid Res. 1984, 12:387-395.
Epstein et al., 1985, Proc. Natl. Acad. Sci. U.S.A. 82: 3688-3692.
Fairlie WD et al., 2000, Gene 254: 67-76.
Freiberg & Zhu, 2004, Int. J. Pharm. 282: 1-18.
Henikoff & Henikoff, Proc. Natl. Acad. Sci. USA 1992, 89:10915-10919.
Hromas R et al., 1997, Biochim Biophys Acta. 1354:40-4.
Jensen MA et al., Eur. J. Immunol, 2007, 37:4, 1139-1148.
Johnen H et al., 2007 Nat Med. 13:1333-40.
Katoh M, Int J Mol Med, 2006. 17:951-955.
Kempf T et al., 2006, Circ Res.98:351-360.
Langer et al., 1981, J. Biomedical Material Research 15: 267-277.
Langer, 1982, Chem. Tech. 12: 98-105.
Lawton LN, Gene, 1997, 203:17-26.
Mekhaiel, et al., 2011, Sci Rep. 1:124.
Macia L. et al., PLoS One., Apr. 13, 2012, vol. 7, No. 4, pp. e34868.
Moore AG et al., 2000, J Clin Endocrinol Metab 85: 4781-4788.
Needleman and Wunsch J. Mol. Biol., 1970, 48:443-453.
Paralkar VM et al., 1998, J Biol Chem. 273:13760-7.
Sidman et al., 1983, Biopolymers 22: 547-56.
Strelau J et al., 2009, J Neurosci. 29 :13640-13648.
Tamary H et al., 2008, Blood. 112:5241-4.
Tanno T et al., 2007, Nat Med 13:1096-1101.
Van Heeke & Schuster, J. Biol. Chem., 1989, 264: 5503-5509.
White et al., Protein Expr, Purif, 2001, 21:3, 446-455.
Wischke & Schwendeman, 2008, Int. J. Pharm. 364: 298-327.
Xu J et al., 2006, Circ Res. 98:342-50.
Zimmermann MB et al., 2008 Am J Clin Nutr 88:1026-31.
Creative BioMart, Recombinant Human Growth Differentiation Factor 15. Fc Chimera; Oct. 23, 2010 (according to document properties for posted document); (Retrieved from the Internet Apr. 9, 2013 http://img.creativebiomart.net1pdf/GDF15-204H.GDF15,Fc%20Chimera.pdf>.
Dostalova Ivana, et al.: Increased serum concentrations of macrophage inhibitory cytokine-1 in patients with obesity and type 2 diabetes mellitus: the influence of very low calorie diet.: European Journal of Endocrinology/European Federation of Endocrine Societies Sep. 2009, vol. 161, No. 3, (Sep. 2009), pp. 397-404.
Lind Lars, et al.: "Growth-differentiation factor-15 is an independent marker of cardiovascular dysfunction and disease in the elderly; results from the Prospective Investigation of the Vasculature in Uppsala Seniors (PIVUS) Study", European Heart Journal (Online), Oxford University Press, GB, US, NI., vol. 30, No. 19, Oct. 1, 2009 (Oct. 1, 2009), pp. 2346-2353.
Lajer Maria, et al.: "Plasma growth differentiation factor-15 independently predicts all-cause and cardiovascular mortality as well as deterioration of kidney function in type 1 diabetic patients with nephropathy.", Diabetes Care, vol. 33, No. 7, Jul. 2010 (Jul. 2010), pp. 1567-1572.
Gribskov, M. and Devereux, J., eds., Sequence Analysis Primer, 1991, New York: M. Stockton Press.
Griffin, A.M., and Griffin, H.G., eds., Computer Analysis of Sequence Data, Part I, 1994, New Jersey: Humana Press.
K. Gunasekaran, et al: "Enhancing Antibody 2-24 Fc Heterodimer Formation through Electrostatic Steering Effects: Applications to Bispecific Molecules and Monovalent IgG", Journal of Biological Chemistry, vol. 285, No. 25, Jun. 18, 2010 (Jun. 18, 2010), pp. 19637-19646.
NCBI Reference Sequence: NP 004855.2, 2014.
White, et al.—Rapid Immune Responses to a Botulinum Neurotoxin He Subunit Vaccine through In Vivo Targeting to Antigen-Presenting Cells Infect. Immun.; Epub May 16, 2011; 79(8); 3388-3396.

* cited by examiner

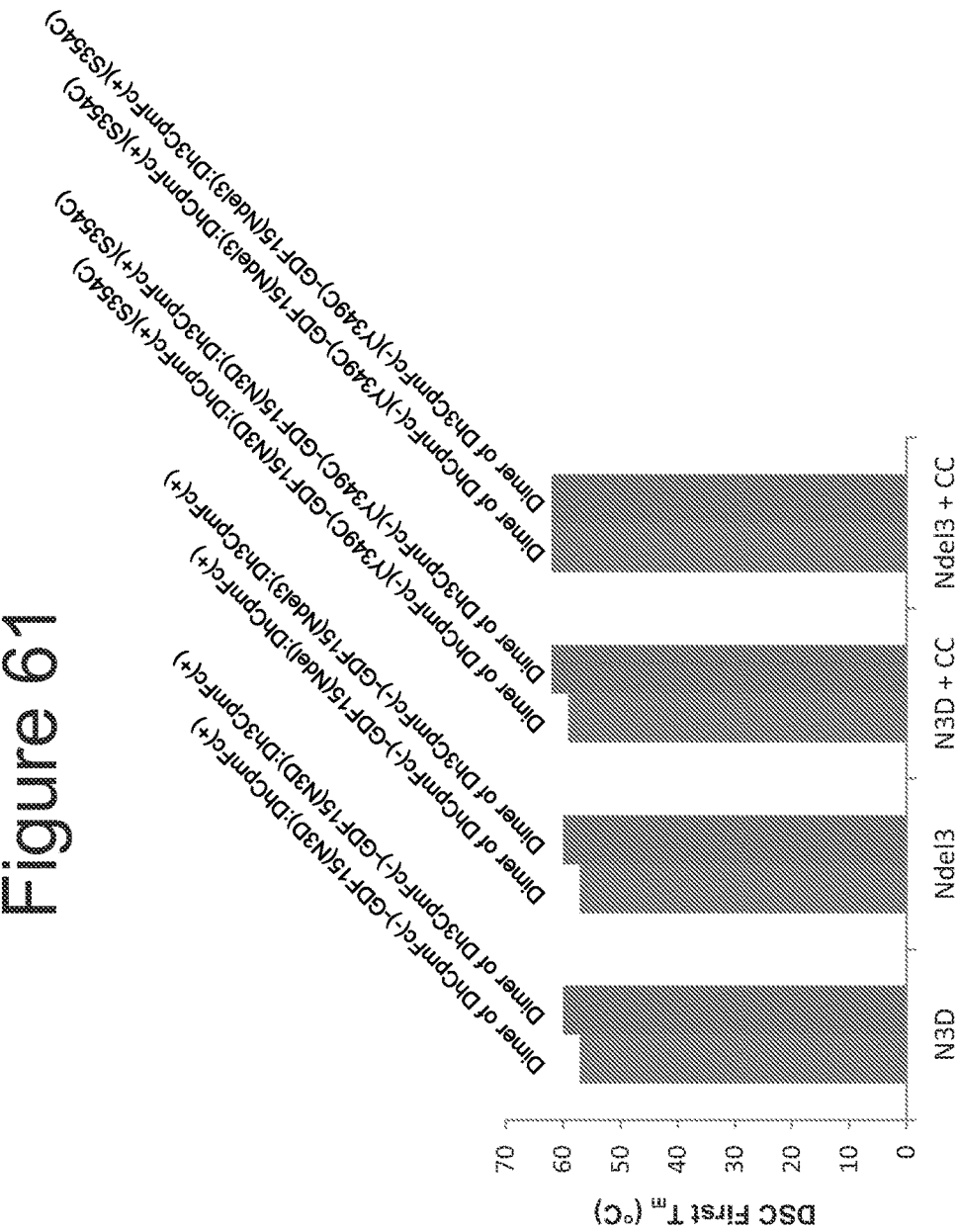

GROWTH DIFFERENTIATION FACTOR 15 (GDF-15) CONSTRUCTS

SEQUENCE LISTING

The instant application contains a Sequence Listing which has been submitted electronically in ASCII format and is hereby incorporated by reference in its entirety. Said ASCII copy, created on Jul. 29, 2014, is named A-1850-WO-PCT_SL.txt and is 630,200 bytes in size.

FIELD OF THE INVENTION

The instant disclosure relates to monomers and multimers comprising a polypeptide comprising a GDF15 region.

BACKGROUND OF THE INVENTION

Growth differentiation factor 15 (GDF15) is a divergent member of the TGFβ superfamily. It is also called macrophage inhibitory cytokine 1 (MIC1) (Bootcov M R, 1997, *Proc Natl Acad Sci* 94:11514-9), placental bone morphogenetic factor (PLAB) (Hromas R 1997, *Biochim Biophys Acta.* 1354:40-4), placental transforming growth factor beta (PTGFB) (Lawton L N 1997, *Gene.* 203:17-26), prostate derived factor (PDF) (Paralkar V M 1998, *J Biol Chem.* 273:13760-7), and nonsteroidal anti-inflammatory drug-activated gene (NAG-1) (Baek S J 2001, *J Biol Chem.* 276: 33384-92).

Human GDF15 gene is located on chromosome 19p13.2-13.1; rat GDF15 gene is located on chromosome 16; and mouse GDF15 gene is located on chromosome 8. The GDF15 open reading frames span two exons (Bottner M 1999, *Gene.* 237:105-11 and NCBI). The mature GDF15 peptide shares low homology with other family members (Katoh M 2006, *Int J Mol Med.* 17:951-5.).

GDF15 is synthesized as a large precursor protein that is cleaved at the dibasic cleavage site to release the carboxy-terminal mature peptide. The mouse and rat GDF15 prepropeptides both contain 303 amino acids. Human full-length precursor contains 308 amino acids. The rodent mature peptides contain 115 amino acids after processing at the RGRR (SEQ ID NO:1) cleavage site. The human mature peptide contains 112 amino acids after processing at the RGRRRAR (SEQ ID NO:2) cleavage site. Human mature GDF15 peptide shares 66.1% and 68.1% sequence similarity with rat and mouse mature GDF15 peptides (Bottner M 1999, *Gene.* 237:105-11; Bauskin A R 2000, *EMBO J.* 19:2212-20; NCBI). There is no glycosylation site in the mature GDF15 peptide.

The mature GDF15 peptide contains the seven conserved cysteine residues required for the formation of the cysteine knot motif (having three intrachain disulfide bonds) and the single interchain disulfide bond that are typical for TGFβ superfamily members. The mature GDF15 peptide further contains two additional cysteine residues that form a fourth intrachain disulfide bond. Biologically active GDF15 is a 25 KD homodimer of the mature peptide covalently linked by one interchain disulfide bond.

GDF15 circulating levels have been reported to be elevated in multiple pathological and physiological conditions, most notably pregnancy (Moore A G 2000. *J Clin Endocrinol Metab* 85: 4781-4788), β-thalassemia (Tanno T 2007, *Nat Med* 13:1096-101; Zimmermann M B, 2008 *Am J Clin Nutr* 88:1026-31), and congenital dyserythropoietic anemia (Tamary H 2008, *Blood.* 112:5241-4). GDF15 has also been linked to multiple biological activities in literature reports. Studies of GDF15 knockout and transgenic mice suggested that GDF15 may be protective against ischemic/reperfusion- or overload-induced heart injury (Kempf T, 2006, *Circ Res.* 98:351-60; Xu J, 2006, *Circ Res.* 98:342-50), protective against aging-associated motor neuron and sensory neuron loss (Strelau J, 2009, *J Neurosci.* 29:13640-8), mildly protective against metabolic acidosis in kidney, and may cause cachexia in cancer patients (Johnen H 2007 *Nat Med.* 11:1333-40). Many groups also have studied the role of GDF15 in cell apoptosis and proliferation and reported controversial results using different cell culture and xenograft models. Studies on transgenic mice showed that GDF15 is protective against carcinogen or Apc mutation induced neoplasia in intestine and lung (Baek S J 2006, *Gastroenterology.* 131:1553-60; Cekanova M 2009, *Cancer Prev Res* 2:450-8).

SUMMARY OF THE INVENTION

Provided herein are fusion proteins comprising a GDF15 polypeptide or a GDF15 mutant polypeptide and an Fc domain.

In a one embodiment, the Fc domain comprises a sequence selected from the group consisting of SEQ ID NOs:16, 22, 28, 29, 33, 35, 38, 48, 85, 91, 106, 132, 141, 148, 155, 162, 169, 176, 183, 192, 199, 206, 213, 220, 227, 233, 236, 268, 275, 281, 282, 283, 284, 285, 286, 287, 288, 289, 290, 291, 292, 293, 294, 295, 296, 297, 298, 299, 300, 301 and 302. In another embodiment, the GDF15 polypeptide or a GDF15 mutant polypeptide comprises a sequence selected from the group consisting of SEQ ID NOs:4, 8, 12, 25, 52 and 55. In another embodiment, the fusion protein further comprises a polypeptide linker. In one embodiment, the polypeptide linker has a sequence selected from the group consisting of SEQ ID NOs:18, 30, 34, 40, 58, 61, 64, 69, 72, 75, 78, 113, 116, 119, 122, 125, 128. In one embodiment, the fusion protein comprises two or more Fc domains. In one embodiment, the fusion protein comprises two or more polypeptide linkers. In one embodiment, the fusion protein comprises a sequence selected from the group consisting of SEQ ID NOs: 46, 24, 27, 32, 37, 20, 42, 50, 54, 57, 60, 63, 66, 68, 71, 74, 77, 82, 84, 88, 93, 96, 98, 100, 102, 104, 108, 134, 137, 139, 143, 146, 150, 153, 269, 272, 276, 279, 157, 160, 164, 167, 171, 174, 178, 181, 185, 188, 194, 197, 201, 204, 208, 211, 215, 218, 222, 225, 229, 232, 233, 238 and 240.

Also provided herein are dimers comprising (i) a first polypeptide chain comprising one of the foregoing fusion proteins, and (ii) a second polypeptide chain comprising an Fc domain. In yet a further embodiment, the construct further comprises a sequence selected from the group consisting of SEQ ID NOs: 16, 22, 28, 29, 33, 35, 38, 48, 85, 91, 106, 132, 141, 148, 155, 162, 169, 176, 183, 192, 199, 206, 213, 220, 227, 233, 236, 268, 275, 281, 282, 283, 284, 285, 286, 287, 288, 289, 290, 291, 292, 293, 294, 295, 296, 297, 298, 299, 300, 301 and 302.

In one embodiment, the first and second polypeptide chains are non-covalently associated. In another embodiment, the first and second polypeptide chains are covalently associated. In one embodiment, the first and second polypeptide chains are covalently associated via disulfide bonds between their respective Fc domains. In another embodiment, the first and second polypeptide chains are associated by both covalent and non-covalent interactions.

In a particular embodiment, a dimer is provided comprising: (a) two fusion proteins comprising the sequence of SEQ ID NO:46; (b) two fusion proteins comprising the sequence of SEQ ID NO:24; or (c) two fusion proteins comprising the sequence of SEQ ID NO:27

In a particular embodiment, a dimer is provided comprising (a) two fusion proteins comprising the sequence of SEQ ID NO:32; or (b) two fusion proteins comprising the sequence of SEQ ID NO:37;

In a particular embodiment, a dimer is provided comprising a first polypeptide chain comprising the sequence of SEQ ID NO:20 and a second polypeptide chain comprising the sequence of SEQ ID NO:17.

In a particular embodiment, a dimer is provided comprising (a) a first polypeptide chain comprising the sequence of SEQ ID NO:42 and a second polypeptide chain comprising the sequence of SEQ ID NO:39; (b) a first polypeptide chain comprising the sequence of SEQ ID NO:50 and a second polypeptide chain comprising the sequence of SEQ ID NO:47; (c) a first polypeptide chain comprising the sequence of SEQ ID NO:54 and a second polypeptide chain comprising the sequence of SEQ ID NO:47; (d) a first polypeptide chain comprising the sequence of SEQ ID NO:57 and a second polypeptide chain comprising the sequence of SEQ ID NO:47; (e) a first polypeptide chain comprising the sequence of SEQ ID NO:60 and a second polypeptide chain comprising the sequence of SEQ ID NO:47; (f) a first polypeptide chain comprising the sequence of SEQ ID NO:63 and a second polypeptide chain comprising the sequence of SEQ ID NO:47; (g) a first polypeptide chain comprising the sequence of SEQ ID NO:66 and a second polypeptide chain comprising the sequence of SEQ ID NO:47; (h) a first polypeptide chain comprising the sequence of SEQ ID NO:68 and a second polypeptide chain comprising the sequence of SEQ ID NO:47; (i) a first polypeptide chain comprising the sequence of SEQ ID NO:71 and a second polypeptide chain comprising the sequence of SEQ ID NO:47; (j) a first polypeptide chain comprising the sequence of SEQ ID NO:74 and a second polypeptide chain comprising the sequence of SEQ ID NO:47; (k) a first polypeptide chain comprising the sequence of SEQ ID NO:77 and a second polypeptide chain comprising the sequence of SEQ ID NO:47; (l) a first polypeptide chain comprising the sequence of SEQ ID NO:80 and a second polypeptide chain comprising the sequence of SEQ ID NO:47; (m) a first polypeptide chain comprising the sequence of SEQ ID NO:82 and a second polypeptide chain comprising the sequence of SEQ ID NO:47; or (n) a first polypeptide chain comprising the sequence of SEQ ID NO:84 and a second polypeptide chain comprising the sequence of SEQ ID NO:47.

In a particular embodiment, a dimer is provided comprising (a) a first polypeptide chain comprising the sequence of SEQ ID NO:88 and a second polypeptide chain comprising the sequence of SEQ ID NO:86; (b) a first polypeptide chain comprising the sequence of SEQ ID NO:93 and a second polypeptide chain comprising the sequence of SEQ ID NO:90; (c) a first polypeptide chain comprising the sequence of SEQ ID NO:96 and a second polypeptide chain comprising the sequence of SEQ ID NO:90; (d) a first polypeptide chain comprising the sequence of SEQ ID NO:98 and a second polypeptide chain comprising the sequence of SEQ ID NO:90; (e) a first polypeptide chain comprising the sequence of SEQ ID NO:100 and a second polypeptide chain comprising the sequence of SEQ ID NO:90; (f) a first polypeptide chain comprising the sequence of SEQ ID NO:102 and a second polypeptide chain comprising the sequence of SEQ ID NO:90; (g) a first polypeptide chain comprising the sequence of SEQ ID NO:104 and a second polypeptide chain comprising the sequence of SEQ ID NO:90; or (h) a first polypeptide chain comprising the sequence of SEQ ID NO:108 and a second polypeptide chain comprising the sequence of SEQ ID NO:105.

In a particular embodiment, a dimer is provided comprising (a) a first polypeptide chain comprising the sequence of SEQ ID NO:112 and a second polypeptide chain comprising the sequence of SEQ ID NO:12; (b) two polypeptide chains, each comprising the sequence of SEQ ID NO:112; (c) two polypeptide chains, each comprising the sequence of SEQ ID NO:115; (d) two polypeptide chains, each comprising the sequence of SEQ ID NO:118; (e) two polypeptide chains, each comprising the sequence of SEQ ID NO:121; (f) two polypeptide chains, each comprising the sequence of SEQ ID NO:124; (g) two polypeptide chains, each comprising the sequence of SEQ ID NO:127; (h) two polypeptide chains, each comprising the sequence of SEQ ID NO:130; or (i) two polypeptide chains, each comprising the sequence of SEQ ID NO:242.

In a particular embodiment, a dimer is provided comprising: (a) a first polypeptide chain comprising the sequence of SEQ ID NO:134 and a second polypeptide chain comprising the sequence of SEQ ID NO:131; (b) a first polypeptide chain comprising the sequence of SEQ ID NO:137 and a second polypeptide chain comprising the sequence of SEQ ID NO:131; (c) a first polypeptide chain comprising the sequence of SEQ ID NO:139 and a second polypeptide chain comprising the sequence of SEQ ID NO:131; (d) a first polypeptide chain comprising the sequence of SEQ ID NO:143 and a second polypeptide chain comprising the sequence of SEQ ID NO:140; (e) a first polypeptide chain comprising the sequence of SEQ ID NO:146 and a second polypeptide chain comprising the sequence of SEQ ID NO:140; (f) a first polypeptide chain comprising the sequence of SEQ ID NO:150 and a second polypeptide chain comprising the sequence of SEQ ID NO:147; (g) a first polypeptide chain comprising the sequence of SEQ ID NO:153 and a second polypeptide chain comprising the sequence of SEQ ID NO:147; (h) a first polypeptide chain comprising the sequence of SEQ ID NO:269 and a second polypeptide chain comprising the sequence of SEQ ID NO:267; (i) a first polypeptide chain comprising the sequence of SEQ ID NO:272 and a second polypeptide chain comprising the sequence of SEQ ID NO:267; (j) a first polypeptide chain comprising the sequence of SEQ ID NO:276 and a second polypeptide chain comprising the sequence of SEQ ID NO:274; or (k) a first polypeptide chain comprising the sequence of SEQ ID NO:279 and a second polypeptide chain comprising the sequence of SEQ ID NO:274.

In a particular embodiment, a dimer is provided comprising: (a) a first polypeptide chain comprising the sequence of SEQ ID NO:157 and a second polypeptide chain comprising the sequence of SEQ ID NO:154; (b) a first polypeptide chain comprising the sequence of SEQ ID NO:160 and a second polypeptide chain comprising the sequence of SEQ ID NO:154; (c) a first polypeptide chain comprising the sequence of SEQ ID NO:164 and a second polypeptide chain comprising the sequence of SEQ ID NO:161; (d) a first polypeptide chain comprising the sequence of SEQ ID NO:167 and a second polypeptide chain comprising the sequence of SEQ ID NO:161.

In a particular embodiment, a dimer is provided comprising: (a) a first polypeptide chain comprising the sequence of SEQ ID NO:171 and a second polypeptide chain comprising the sequence of SEQ ID NO:168; or (b) a first polypeptide chain comprising the sequence of SEQ ID NO:174 and a second polypeptide chain comprising the sequence of SEQ ID NO:168

In a particular embodiment, a dimer is provided comprising: (a) a first polypeptide chain comprising the sequence of SEQ ID NO:178 and a second polypeptide chain comprising the sequence of SEQ ID NO:175; (b) a first polypeptide chain comprising the sequence of SEQ ID NO:181 and a second polypeptide chain comprising the sequence of SEQ ID NO:175; (c) a first polypeptide chain comprising the sequence of SEQ ID NO:185 and a second polypeptide chain comprising the sequence of SEQ ID NO:182; (d) a first polypeptide chain comprising the sequence of SEQ ID NO:188 and a second polypeptide chain comprising the sequence of SEQ ID NO:182; (e) a first polypeptide chain comprising the sequence of SEQ ID NO:194 and a second polypeptide chain comprising the sequence of SEQ ID NO:191; (f) a first polypeptide chain comprising the sequence of SEQ ID NO:197 and a second polypeptide chain comprising the sequence of SEQ ID NO:191; (g) a first polypeptide chain comprising the sequence of SEQ ID NO:201 and a second polypeptide chain comprising the sequence of SEQ ID NO:198; or (h) a first polypeptide chain comprising the sequence of SEQ ID NO:204 and a second polypeptide chain comprising the sequence of SEQ ID NO:198.

In a particular embodiment, a dimer is provided comprising: (a) a first polypeptide chain comprising the sequence of SEQ ID NO:208 and a second polypeptide chain comprising the sequence of SEQ ID NO:205; (b) a first polypeptide chain comprising the sequence of SEQ ID NO:211 and a second polypeptide chain comprising the sequence of SEQ ID NO:205; (c) a first polypeptide chain comprising the sequence of SEQ ID NO:215 and a second polypeptide chain comprising the sequence of SEQ ID NO:212; or (d) a first polypeptide chain comprising the sequence of SEQ ID NO:218 and a second polypeptide chain comprising the sequence of SEQ ID NO:212.

In a particular embodiment, a dimer is provided comprising: (a) a first polypeptide chain comprising the sequence of SEQ ID NO:222 and a second polypeptide chain comprising the sequence of SEQ ID NO:219; (b) a first polypeptide chain comprising the sequence of SEQ ID NO:225 and a second polypeptide chain comprising the sequence of SEQ ID NO:219; (c) a first polypeptide chain comprising the sequence of SEQ ID NO:229 and a second polypeptide chain comprising the sequence of SEQ ID NO:226; or (d) a first polypeptide chain comprising the sequence of SEQ ID NO:232 and a second polypeptide chain comprising the sequence of SEQ ID NO:226.

In a particular embodiment, a dimer is provided comprising: (a) two polypeptide chains, each comprising the sequence of SEQ ID NO:235; (b) two polypeptide chains, each comprising the sequence of SEQ ID NO:238; or (c) two polypeptide chains, each comprising the sequence of SEQ ID NO:240.

In certain embodiments, a tetramer is provided, comprising (i) a first dimer comprising one of the foregoing dimers and (ii) a second dimer comprising one of the foregoing dimers. In certain embodiments, the first polypeptide chain of the first dimer is linked to the first polypeptide chain of the second dimer via an interchain disulfide bond between their respective GDF15 regions.

In some embodiments, the dimer is not selected from the group comprising DhCpmFc(−)-($G_4S$)$_4$-GDF15:DhCpmFc(+), DhCpmFc(+)-($G_4S$)$_4$-GDF15:DhCpmFc(−), DhCpmFc(−)-($G_4S$)$_4$-GDF15(H6D):DhCpmFc(+), DhCpmFc(+)-($G_4S$)$_4$-GDF15(H6D):DhCpmFc(−), DhCpmFc(+)-($G_4S$)$_4$-GDF15(N3Q):DhCpmFc(−), DhCpmFc(+)-GDF15:DhCpmFc(−), DhCpmFc(+)-$G_4$-GDF15:DhCpmFc(−), DhCpmFc(+)-($G_4S$)$_2$-GDF15:DhCpmFc(−), DhCpmFc(+)-($G_4Q$)$_4$-GDF15:DhCpmFc(−), DhCpmFc(+)(L351C)-$G_4$-GDF15:DhCpmFc(−)(L351C), DhCpmFc(+)(S354C)-$G_4$-GDF15:DhCpmFc(−)(Y349C), CpmFc(−)-($G_4S$)$_4$-GDF15:CpmFc(+), Fc-($G_4S$)$_8$-Fc-GS($G_4S$)$_4$-GDF15, Fc-($G_4S$)$_3$-Fc-GS($G_4S$)$_4$-GDF15 and Fc-($G_4S$)$_5$-Fc-GS($G_4S$)$_4$-GDF15.

In some embodiments, the dimer is not selected from the group consisting of DhCpmFc(−)-($G_4S$)$_4$-GDF15:DhCpmFc(+), DhCpmFc(+)-($G_4S$)$_4$-GDF15:DhCpmFc(−), DhCpmFc(−)-($G_4S$)$_4$-GDF15(H6D):DhCpmFc(+), DhCpmFc(+)-($G_4S$)$_4$-GDF15(H6D):DhCpmFc(−), DhCpmFc(+)-($G_4S$)$_4$-GDF15(N3Q):DhCpmFc(−), DhCpmFc(+)-GDF15:DhCpmFc(−), DhCpmFc(+)-$G_4$-GDF15:DhCpmFc(−), DhCpmFc(+)-($G_4S$)$_2$-GDF15:DhCpmFc(−), DhCpmFc(+)-($G_4Q$)$_4$-GDF15:DhCpmFc(−), DhCpmFc(+)(L351C)-$G_4$-GDF15:DhCpmFc(−)(L351C) and DhCpmFc(+)(S354C)-$G_4$-GDF15:DhCpmFc(−)(Y349C).

In some embodiments, the fusion protein is not a selected from the group consisting of Fc-($G_4S$)$_8$-Fc-GS($G_4S$)$_4$-GDF15, Fc-($G_4S$)$_3$-Fc-GS($G_4S$)$_4$-GDF15 and Fc-($G_4S$)$_5$-Fc-GS($G_4S$)$_4$-GDF15.

In some embodiments, the dimer is not selected from the group consisting of DhCpmFc(+)(L351C)-$G_4$-GDF15:DhCpmFc(−)(L351C) and DhCpmFc(+)(S354C)-$G_4$-GDF15:DhCpmFc(−)(Y349C).

In some embodiments, the dimer is not DhCpmFc(−)-($G_4S$)$_4$-GDF15:DhCpmFc(+), DhCpmFc(+)-($G_4S$)$_4$-GDF15:DhCpmFc(−), DhCpmFc(−)-($G_4S$)$_4$-GDF15(H6D):DhCpmFc(+), DhCpmFc(+)-($G_4S$)$_4$-GDF15(H6D):DhCpmFc(−), DhCpmFc(+)-($G_4S$)$_4$-GDF15(N3Q):DhCpmFc(−), DhCpmFc(+)-GDF15:DhCpmFc(−), DhCpmFc(+)-$G_4$-GDF15:DhCpmFc(−), DhCpmFc(+)-($G_4S$)$_2$-GDF15:DhCpmFc(−), DhCpmFc(+)-($G_4Q$)$_4$-GDF15:DhCpmFc(−), DhCpmFc(+)(L351C)-$G_4$-GDF15:DhCpmFc(−)(L351C), DhCpmFc(+)(S354C)-$G_4$-GDF15:DhCpmFc(−)(Y349C), CpmFc(−)-($G_4S$)$_4$-GDF15:CpmFc(+), Fc-($G_4S$)$_8$-Fc-GS($G_4S$)$_4$-GDF15, Fc-($G_4S$)$_3$-Fc-GS($G_4S$)$_4$-GDF15 or Fc-($G_4S$)$_5$-Fc-GS($G_4S$)$_4$-GDF15.

In some embodiments, the dimer is not DhCpmFc(−)-($G_4S$)$_4$-GDF15:DhCpmFc(+), DhCpmFc(+)-($G_4S$)$_4$-GDF15:DhCpmFc(−), DhCpmFc(−)-($G_4S$)$_4$-GDF15(H6D):DhCpmFc(+), DhCpmFc(+)-($G_4S$)$_4$-GDF15(H6D):DhCpmFc(−), DhCpmFc(+)-($G_4S$)$_4$-GDF15(N3Q):DhCpmFc(−), DhCpmFc(+)-GDF15:DhCpmFc(−), DhCpmFc(+)-$G_4$-GDF15:DhCpmFc(−), DhCpmFc(+)-($G_4S$)$_2$-GDF15:DhCpmFc(−), DhCpmFc(+)-($G_4Q$)$_4$-GDF15:DhCpmFc(−), DhCpmFc(+)(L351C)-$G_4$-GDF15:DhCpmFc(−)(L351C) or DhCpmFc(+)(S354C)-$G_4$-GDF15:DhCpmFc(−)(Y349C).

In some embodiments, the fusion protein is not selected from the group consisting of Fc-($G_4S$)$_8$-Fc-GS($G_4S$)$_4$-GDF15, Fc-($G_4S$)$_3$-Fc-GS($G_4S$)$_4$-GDF15 and Fc-($G_4S$)$_5$-Fc-GS($G_4S$)$_4$-GDF15.

In some embodiments, the fusion protein is not selected from the group consisting of DhCpmFc(+)(L351C)-$G_4$-GDF15:DhCpmFc(−)(L351C) and DhCpmFc(+)(S354C)-$G_4$-GDF15:DhCpmFc(−)(Y349C).

In some embodiments, the dimer is not DhCpmFc(−)-($G_4S$)$_4$-GDF15:DhCpmFc(+). In some embodiments, the dimer is not DhCpmFc(+)-($G_4S$)$_4$-GDF15:DhCpmFc(−). In some embodiments, the dimer is not DhCpmFc(−)-($G_4S$)$_4$-GDF15(H6D):DhCpmFc(+). In some embodiments, the dimer is not DhCpmFc(+)-($G_4S$)$_4$-GDF15(H6D):DhCpmFc(−). In some embodiments, the dimer is not DhCpmFc(+)-

(G₄S)₄-GDF15(N3Q):DhCpmFc(−). In some embodiments, the dimer is not DhCpmFc(+)-GDF15:DhCpmFc(−). In some embodiments, the dimer is not DhCpmFc(+)-G₄-GDF15:DhCpmFc(−). In some embodiments, the dimer is not DhCpmFc(+)-(G₄S)₂-GDF15:DhCpmFc(−). In some embodiments, the dimer is not DhCpmFc(+)-(G₄Q)₄-GDF15:DhCpmFc(−). In some embodiments, the dimer is not DhCpmFc(+)(L351C)-G₄-GDF15:DhCpmFc(−)(L351C). In some embodiments, the dimer is not DhCpmFc(+)(S354C)-G₄-GDF15:DhCpmFc(−)(Y349C). In some embodiments, the dimer is not CpmFc(−)-(G₄S)₄-GDF15:CpmFc(+). In some embodiments, the dimer is not Fc-(G₄S)₈-Fc-GS(G₄S)₄-GDF15. In some embodiments, the dimer is not Fc-(G₄S)₃-Fc-GS(G₄S)₄-GDF15. In some embodiments, the dimer is not Fc-(G₄S)₅-Fc-GS(G₄S)₄-GDF15.

Also provided herein are fusion proteins comprising a GDF15 polypeptide or a GDF15 mutant polypeptide and a human serum albumin (HSA) polypeptide. In a further embodiment, the HSA polypeptide the sequence of SEQ ID NO:110. In another embodiment, the GDF15 polypeptide or a GDF15 mutant polypeptide comprises a sequence selected from the group consisting of SEQ ID NOs:4, 8, 12, 25, 52 and 55. In another embodiment, the fusion protein further comprises a polypeptide linker, joining the GDF15 polypeptide or GDF15 mutant polypeptide to the HSA polypeptide. In one embodiment, the polypeptide linker has a sequence selected from the group consisting of SEQ ID NOs:18, 30, 34, 40, 58, 61, 64, 69, 72, 75, 78, 113, 116, 119, 122, 125, 128. In one embodiment, the fusion protein comprises two or more HSA polypeptides. In one embodiment, the fusion protein comprises a sequence selected from the group consisting of SEQ ID NOs: 115, 118, 121, 124, 127 and 130.

Also provided herein are dimers comprising (i) a first polypeptide chain comprising a fusion protein comprising a first GDF15 region and a first HSA polypeptide, and (ii) a second polypeptide chain comprising a second HSA polypeptide. In some embodiments, the second polypeptide chain further comprises a second GDF15 region. In some embodiments, the dimer is a heterodimer (i.e., the first and second polypeptide chain have different sequences). In some embodiments, the dimer is a homodimer (i.e., the first and second polypeptide chain have the same sequence). In some embodiments, the first polypeptide chain comprises a sequence selected from the group consisting of SEQ ID NOs: 115, 118, 121, 124, 127 and 130. In some embodiments, the second polypeptide chain comprises a sequence selected from the group consisting of SEQ ID NOs: 115, 118, 121, 124, 127 and 130. In one embodiment, the first and second polypeptide chains are non-covalently associated. In another embodiment, the first and second polypeptide chains are covalently associated. In one embodiment, the second polypeptide chain comprises a second GDF15 region and first and second polypeptide chains are covalently associated via disulfide bonds between their respective GDF15 regions. In another embodiment, the first and second polypeptide chains are associated by both covalent and non-covalent interactions.

Also provided herein are dimers comprising (i) a first polypeptide chain comprising a fusion protein comprising a first GDF15 region and an HSA polypeptide, and (ii) a second polypeptide chain comprising a second GDF15 region. In some embodiments, the first polypeptide chain comprises a sequence selected from the group consisting of SEQ ID NOs: 115, 118, 121, 124, 127 and 130. In some embodiments, the second polypeptide chain comprises a sequence selected from the group consisting of SEQ ID NOs: 4, 8, 12, 25, 52 and 55. In one embodiment, the first and second polypeptide chains are non-covalently associated. In another embodiment, the first and second polypeptide chains are covalently associated. In another embodiment, the first and second polypeptide chains are associated by both covalent and non-covalent interactions.

BRIEF DESCRIPTION OF THE DRAWINGS

FIG. 61 is a bar graph showing DSC first Tm (° C.) with respect to (a) (for pair of bars captioned "N3D"), a dimer of DhCpmFc(−)-GDF15(N3D):DhCpmFc(+) and a dimer of Dh3CpmFc(−)-GDF15(N3D):DhCpmFc(+); (b) (for the pair of bars captioned "Ndel3"), a dimer of DhCpmFc(−)-GDF15(Ndel3):DhCpmFc(+) and a dimer of Dh3CpmFc(−)-GDF15(Ndel):DhCpmFc(+); (c) (for the pair of bars captioned "N3D+CC"), a dimer of DhCpmFc(−)(Y349C)-GDF15(N3D):DhCpmFc(+)(S354C) and a dimer of Dh3CpmFc(−)(Y349C)-GDF15(N3D):DhCpmFc(+)(S354C); and (d) (for the pair of bars captioned "Ndel3+CC"), a dimer of DhCpmFc(−)(Y349C)-GDF15(Ndel3):DhCpmFc(+)(S354C) and a dimer of Dh3CpmFc(−)(Y349C)-GDF15(Ndel3):DhCpmFc(+)(S354C).

DETAILED DESCRIPTION OF THE INVENTION

Figure 1:
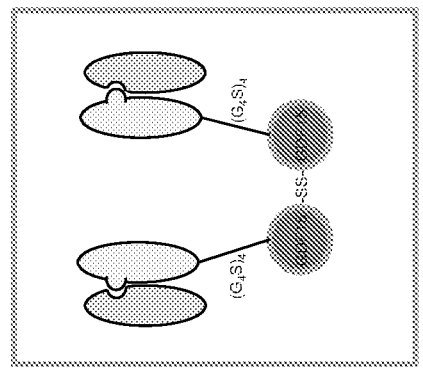
FIG. 1 is a graphic depicting of a knob-hole construct comprising a dimer of two DhknobFc-(G₄S)₄-GDF15:DhholeFc heterodimers.
Figure 2:
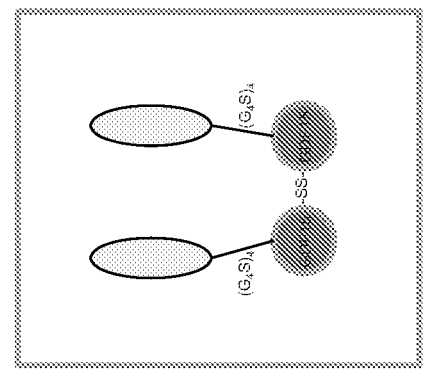
FIG. 2 is a graphic depicting a DhMonoFc construct comprising a dimer of two DhMonoFc-(G₄S)₄-GDF15 fusion proteins.

The instant disclosure provides fusion proteins comprising a GDF15 polypeptide or a GDF15 mutant polypeptides and constructs comprising such fusion proteins. Also provided is the generation and uses of the disclosed molecules, for example in treating a metabolic disorder, such as Type 2 diabetes, elevated glucose levels, elevated insulin levels, dyslipidemia or obesity. GDF15 polypeptides, GDF15 mutant polypeptides, and certain polypeptide constructs comprising GDF15 polypeptides and GDF15 mutant polypeptides, are described in co-owned PCT/US2012/032415, filed Apr. 5, 2012, and PCT/2013/023465, filed Jan. 28, 2013, both of which are expressly incorporated by reference herein for any purpose.

Recombinant polypeptide and nucleic acid methods used herein, including in the Examples, are generally those set forth in Sambrook et al., Molecular Cloning: A Laboratory Manual (Cold Spring Harbor Laboratory Press, 1989) or Current Protocols in Molecular Biology (Ausubel et al., eds., Green Publishers Inc. and Wiley and Sons 1994).

I. General Definitions

Following convention, as used herein "a" and "an" mean "one or more" unless specifically indicated otherwise.

As used herein, the terms "amino acid" and "residue" are interchangeable and, when used in the context of a peptide or polypeptide, refer to both naturally-occurring and synthetic amino acids, as well as amino acid analogs, amino acid mimetics and non-naturally-occurring amino acids that are chemically similar to the naturally-occurring amino acids.

The terms "naturally-occurring amino acid" and "naturally encoded amino acid" are used interchangeably and refer to an amino acid that is encoded by the genetic code, as well as those amino acids that are encoded by the genetic code that are modified after synthesis, e.g., hydroxyproline, γ-carboxyglutamate, and O-phosphoserine.

An "amino acid analog" is a compound that has the same basic chemical structure as a naturally-occurring amino acid, i.e., an α carbon that is bound to a hydrogen, a carboxyl group, an amino group, and an R group, e.g., homoserine, norleucine, methionine sulfoxide, methionine methyl sulfonium. Such analogs can have modified R groups (e.g., norleucine) or modified peptide backbones, but will retain the same basic chemical structure as a naturally-occurring amino acid.

An "amino acid mimetic" is a chemical compound that has a structure that is different from the general chemical structure of an amino acid, but that functions in a manner similar to a naturally-occurring amino acid. Examples include a methacryloyl or acryloyl derivative of an amide, β-, γ-, δ-imino acids (such as piperidine-4-carboxylic acid) and the like.

The terms "non-naturally-occurring amino acid" and "non-naturally encoded amino acid" are used interchangeably and refer to a compound that has the same basic chemical structure as a naturally-occurring amino acid, but is not incorporated into a growing polypeptide chain by the translation complex. "Non-naturally-occurring amino acid" also includes, but is not limited to, amino acids that occur by modification (e.g., posttranslational modifications) of a naturally encoded amino acid (including but not limited to, the 20 common amino acids) but are not themselves naturally incorporated into a growing polypeptide chain by the translation complex. A non-limiting lists of examples of non-naturally-occurring amino acids that can be inserted into a polypeptide sequence or substituted for a wild-type residue in polypeptide sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl) alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionoic acid (Dpr), α, γ-diaminobutyric acid (Dab), diaminopropionic acid (Dap), cyclohexylalanine (Cha), 4-methyl-phenylalanine (MePhe), β, β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), N-acetylglucosaminyl-L-serine, N-acetylglucosylaminyl-L-threonine, O-phosphotyrosine and other similar amino acids, and derivatized forms of any of those specifically listed.

Also included in the definition of "non-naturally-occurring amino acid" is any amino acid comprising the structure

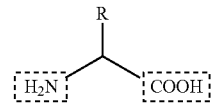

wherein the R group is any substituent other than the one used in the twenty natural amino acids.

In some embodiments, the non-naturally encoded amino acid comprises a carbonyl group. In some embodiments, the non-naturally encoded amino acid has the structure:

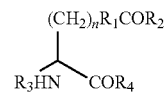

wherein n is 0-10; $R_1$ is an alkyl, aryl, substituted alkyl, or substituted aryl; $R_2$ is H, an alkyl, aryl, substituted alkyl, and substituted aryl; and $R_3$ is H, an amino acid, a polypeptide, or an amino terminus modification group, and $R_4$ is H, an amino acid, a polypeptide, or a carboxy terminus modification group.

In some embodiments, the non-naturally encoded amino acid comprises an aminooxy group. In some embodiments, the non-naturally encoded amino acid comprises a hydrazide group. In some embodiments, the non-naturally encoded amino acid comprises a hydrazine group. In some embodiments, the non-naturally encoded amino acid residue comprises a semicarbazide group.

In some embodiments, the non-naturally encoded amino acid residue comprises an azide group. In some embodiments, the non-naturally encoded amino acid has the structure:

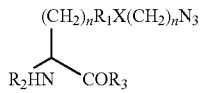

wherein n is 0-10; $R_1$ is an alkyl, aryl, substituted alkyl, substituted aryl or not present; X is O, N, S or not present; m is 0-10; $R_2$ is H, an amino acid, a polypeptide, or an amino terminus modification group, and $R_3$ is H, an amino acid, a polypeptide, or a carboxy terminus modification group.

In some embodiments, the non-naturally encoded amino acid comprises an alkyne group. In some embodiments, the non-naturally encoded amino acid has the structure:

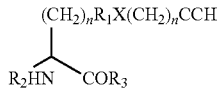

wherein n is 0-10; $R_1$ is an alkyl, aryl, substituted alkyl, or substituted aryl; X is O, N, S or not present; m is 0-10, $R_2$ is H, an amino acid, a polypeptide, or an amino terminus modification group, and $R_3$ is H, an amino acid, a polypeptide, or a carboxy terminus modification group.

The term "substituted" means that a hydrogen atom on a molecule or group is replaced with a group or atom, which is referred to as a substituent. Typical substituents include: halogen, $C_{1-8}$alkyl, hydroxyl, $C_{1-8}$alkoxy, —$NR^xR^x$, nitro, cyano, halo or perhalo$C_{1-8}$alkyl, $C_{2-8}$alkenyl, $C_{2-8}$alkynyl, —$SR^x$, —$S(=O)_2R^x$, —$C(=O)OR^x$, —$C(=O)R^x$, wherein each $R^x$ is independently hydrogen or $C_1$-$C_8$ alkyl. It is noted that when the substituent is —$NR^xR^x$, the $R^x$ groups may be joined together with the nitrogen atom to form a ring.

The term "alkyl" means a straight or branched chain hydrocarbon. Representative examples of alkyl groups include methyl, ethyl, propyl, isopropyl, butyl, isobutyl, tert-butyl, sec-butyl, pentyl and hexyl. Typical alkyl groups are alkyl groups having from 1 to 8 carbon atoms, which groups are commonly represented as $C_{1-8}$alkyl.

The term "alkoxy" means an alkyl group bonded to an oxygen atom. Representative examples of alkoxy groups include methoxy, ethoxy, tert-butoxy, propoxy and isobutoxy. Common alkoxy groups are $C_{1-8}$alkoxy.

The term "halogen" or "halo" means chlorine, fluorine, bromine or iodine.

The term "alkenyl" means a branched or straight chain hydrocarbon having one or more carbon-carbon double bonds. Representative examples alkenyl groups include ethenyl, propenyl, allyl, butenyl and 4-methylbutenyl. Common alkenyl groups are $C_{2-8}$alkenyl.

The term "alkynyl" means a branched or straight chain hydrocarbon having one or more carbon-carbon triple bonds. Representative examples of alkynyl groups include ethynyl, propynyl (propargyl) and butynyl. Common alkynyl groups are $C_{2-8}$ alkynyl.

The term "cycloalkyl" means a cyclic, nonaromatic hydrocarbon. Examples of cycloalkyl groups include cyclopropyl, cyclobutyl, cyclopentyl, cyclohexyl and cycloheptyl. A cycloalkyl group can contain one or more double bond. Examples of cycloalkyl groups that contain double bonds include cyclopentenyl, cyclohexenyl, cyclohexadienyl and cyclobutadienyl. Common cycloalkyl groups are $C_{3-8}$ cycloalkyl groups.

The term "perfluoroalkyl" means an alkyl group in which all of the hydrogen atoms have been replaced with fluorine atoms. Common perfluoroalkyl groups are $C_{1-8}$perfluoroalkyl. An example of a common perfluoroalkyl group is —$CF_3$.

The term "acyl" means a group derived from an organic acid by removal of the hydroxy group (—OH). For example, the acyl group $CH_3C(=O)$— is formed by the removal of the hydroxy group from $CH_3C(=O)OH$.

The term "aryl" means a cyclic, aromatic hydrocarbon. Examples of aryl groups include phenyl and naphthyl. Common aryl groups are six to thirteen membered rings.

The term "heteroatom" as used herein means an oxygen, nitrogen or sulfur atom.

The term "heteroaryl" means a cyclic, aromatic hydrocarbon in which one or more carbon atoms of an aryl group have been replaced with a heteroatom. If the heteroaryl group contains more than one heteroatom, the heteroatoms may be the same or different. Examples of heteroaryl groups include pyridyl, pyrimidinyl, imidazolyl, thienyl, furyl, pyrazinyl, pyrrolyl, indolyl, triazolyl, pyridazinyl, indazolyl, purinyl, quinolizinyl, isoquinolyl, quinolyl, naphthyridinyl, quinoxalinyl, isothiazolyl and benzo[b]thienyl. Common heteroaryl groups are five to thirteen membered rings that contain from 1 to 4 heteroatoms. Heteroaryl groups that are five and six membered rings that contain 1 to 3 heteroatoms are particularly common.

The term "heterocycloalkyl" means a cycloalkyl group in which one or more of the carbon atoms has been replaced with a heteroatom. If the heterocycloalkyl group contains more than one heteroatom, the heteroatoms may be the same or different. Examples of heterocycloalkyl groups include tetrahydrofuryl, morpholinyl, piperazinyl, piperidinyl and pyrrolidinyl. It is also possible for the heterocycloalkyl group to have one or more double bonds, but is not aromatic. Examples of heterocycloalkyl groups containing double bonds include dihydrofuran. Common heterocycloalkyl groups are three to ten membered rings containing from 1 to 4 heteroatoms. Heterocycloalkyl groups that are five and six membered rings that contain 1 to 2 heteroatoms are particularly common.

It is also noted that the cyclic ring groups, i.e., aryl, heteroaryl, cycloalkyl, and heterocycloalkyl, can comprise more than one ring. For example, the naphthyl group is a fused bicyclic ring system. It is also intended that the present invention include ring groups that have bridging atoms, or ring groups that have a spiro orientation.

Representative examples of five to six membered aromatic rings, optionally having one or two heteroatoms, are phenyl, furyl, thienyl, pyrrolyl, oxazolyl, thiazolyl, imidazolyl, pyrazolyl, isoxazolyl, isothiazolyl, pyridinyl, pyridazinyl, pyrimidinyl, and pyrazinyl.

Representative examples of partially saturated, fully saturated or fully unsaturated five to eight membered rings, optionally having one to three heteroatoms, are cyclopentyl, cyclohexyl, cycloheptyl, cyclooctyl and phenyl. Further exemplary five membered rings are furyl, thienyl, pyrrolyl, 2-pyrrolinyl, 3-pyrrolinyl, pyrrolidinyl, 1,3-dioxolanyl, oxazolyl, thiazolyl, imidazolyl, 2H-imidazolyl, 2 imidazolinyl, imidazolidinyl, pyrazolyl, 2-pyrazolinyl, pyrazolidinyl, isoxazolyl, isothiazolyl, 1,2-dithiolyl, 1,3-dithiolyl, 3H-1,2-oxathiolyl, 1,2,3-oxadizaolyl, 1,2,4-oxadiazolyl, 1,2,5-oxadiazolyl, 1,3,4oxadiazolyl, 1,2,3 thazolyl, 1,2,4 trizaolyl, 1,3,4-thiadiazolyl, 3H-1,2,3-dioxazolyl, 1,2,4-dioxazolyl, 1,3,2-dioxazolyl, 1,3,4-dioxazolyl, 5H-1,2,5-oxathiazolyl, and 1,3-oxathiolyl.

Further exemplary six membered rings are 2H-pyranyl, 4H-pyranyl, pyridinyl, piperidinyl, 1,4-dioxanyl, morpholinyl, 1,4 dithianyl, thiomorpholinyl, pyndazinyl, pyrimidinyl, pyrazinyl, piperazinyl, 1,3,5 triazinyl, 1,2,4 triazinyl, 4H-1,2-oxazinyl, 2H-1,3-oxazinyl, 6H-1,3-oxazinyl, 6H-1,2-oxazinyl, 1,4-oxazinyl, 2H-1,2-oxazinyl, 4H-1,4-oxazinyl, 1,2,5-oxathiazinyl, 1,4-oxazinyl, o-isoxazinyl, p-isoxazinyl, 1,2,5-oxathiazinyl, 1,2,6-(3 oxathiazinyl, and 1,4,2-oxadiazinyl.

Further exemplary seven membered rings are azepinyl, oxepinyl, thiepinyl and 1,2,4-triazepinyl.

Further exemplary eight membered rings are cyclooctyl, cyclooctenyl and cyclooctadienyl.

Exemplary bicyclic rings consisting of two fused partially saturated, fully saturated or fully unsaturated five and/or six membered rings, optionally having one to four heteroatoms, are indolizinyl, indolyl, isoindolyl, indolinyl, cyclopenta(b)pyridinyl, pyrano(3,4-b)pyrrolyl, benzofuryl, isobenzofuryl, benzo(b)thienyl, benzo(c)thienyl, 1H-indazolyl, indoxazinyl, benzoxazolyl, anthranilyl, benzimidazolyl, benzthiazolyl, purinyl, quinolinyl, isoquinolinyl, cinnolinyl, phthalazinyl, quinazolinyl, quinoxalinyl, 1,8-naphthyridinyl, pteridinyl, indenyl, isoindenyl, naphthyl, tetralinyl, decalinyl, 2H-1-benzopyranyl, pyrido(3,4-b)pyridinyl, pyrido(3,2-b)pyridinyl, pyrido(4,3-b)-pyridinyl, 2H-1,3-benzoxazinyl, 2H-1,4-benzoxazinyl, 1H-2,3-benzoxazinyl, 4H-3,1-benzoxazinyl, 2H-1,2-benzoxazinyl and 4H-1,4-benzoxazinyl.

A cyclic ring group may be bonded to another group in more than one way. If no particular bonding arrangement is specified, then all possible arrangements are intended. For example, the term "pyridyl" includes 2-, 3-, or 4-pyridyl, and the term "thienyl" includes 2-, or 3-thienyl.

The term "isolated nucleic acid molecule" refers to a single or double-stranded polymer of deoxyribonucleotide or ribonucleotide bases read from the 5' to the 3' end (e.g., a GDF15 nucleic acid sequence provided herein), or an analog thereof, that has been separated from at least about 50 percent of polypeptides, peptides, lipids, carbohydrates, polynucleotides or other materials with which the nucleic acid is naturally found when total nucleic acid is isolated from the source cells. Preferably, an isolated nucleic acid molecule is substantially free from any other contaminating nucleic acid molecules or other molecules that are found in the natural environment of the nucleic acid that would interfere with its use in polypeptide production or its therapeutic, diagnostic, prophylactic or research use.

The term "isolated polypeptide" refers to a polypeptide (e.g., a GDF15 polypeptide or GDF15 mutant polypeptide provided herein) that has been separated from at least about 50 percent of polypeptides, peptides, lipids, carbohydrates, polynucleotides, or other materials with which the polypeptide is naturally found when isolated from a source cell. Preferably, the isolated polypeptide is substantially free from any other contaminating polypeptides or other contaminants that are found in its natural environment that would interfere with its therapeutic, diagnostic, prophylactic or research use.

The term "encoding" refers to a polynucleotide sequence encoding one or more amino acids. The term does not require a start or stop codon. An amino acid sequence can be encoded in any one of the different reading frames provided by a polynucleotide sequence.

The terms "identical" and percent "identity," in the context of two or more nucleic acids or polypeptide sequences, refer to two or more sequences or subsequences that are the same. "Percent identity" means the percent of identical residues between the amino acids or nucleotides in the compared molecules and is calculated based on the size of the smallest of the molecules being compared. For these calculations, gaps in alignments (if any) can be addressed by a particular mathematical model or computer program (i.e., an "algorithm"). Methods that can be used to calculate the identity of the aligned nucleic acids or polypeptides include those described in *Computational Molecular Biology*, (Lesk, A. M., ed.), (1988) New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., (1987) Sequence Analysis in Molecular Biology, New York: Academic Press; Sequence Analysis Primer, (Gribskov, M. and Devereux, J., eds.), 1991, New York: M. Stockton Press; and Carillo et al., (1988) *SIAM J. Applied Math.* 48:1073.

In calculating percent identity, the sequences being compared are aligned in a way that gives the largest match between the sequences. The computer program used to determine percent identity is the GCG program package, which includes GAP (Devereux et al., (1984) *Nucl. Acid Res.* 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) *Atlas of Protein Sequence and Structure* 5:345-352 for the PAM 250 comparison matrix; Henikoff et al., (1992) *Proc. Natl. Acad. Sci. U.S.A.* 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, *J. Mol. Biol.* 48:443-13;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

The term "GDF15 polypeptide" means a naturally-occurring or "wild-type" GDF15 expressed in a mammal, including without limitation, a human, rabbit, monkey (e.g. cynomolgous monkey), dog, rat mouse or pig. In one aspect, GDF15 polypeptide refers to any full-length GDF15, e.g., SEQ ID NO:4, which consists of 308 amino acid residues and which is encoded by the nucleotide sequence SEQ ID NO:3; any form comprising the active and prodomains of the polypeptide, e.g., SEQ ID NO:8, which consists of 279 amino acid residues and which is encoded by the nucleotide sequence SEQ ID NO:7, and in which the 29 amino acid residues at the amino-terminal end of the full-length GDF15 (i.e., which constitute the signal peptide) have been removed; and any form of GDF15 comprising the active domain from which the prodomain and signal sequence have been removed, e.g., SEQ ID NO:12, which consists of 112 amino acid residues and which is encoded by the nucleotide sequence SEQ ID NO:11, in which the signal sequence and the prodomain have been removed. GDF15 polypeptides can but need not comprise an amino-terminal methionine, which may be introduced by engineering or as a result of a bacterial expression process.

The term "GDF15 mutant polypeptide" refers to a GDF15 polypeptide (e.g., SEQ ID NOs:4, 8 or 12) that has been modified. Such modifications include, but are not limited to, one or more amino acid substitutions, including substitutions with non-naturally-occurring amino acids non-naturally-occurring amino acid analogs and amino acid mimetics, additions or deletions. In one aspect, the term "GDF15 mutant polypeptide" refers to a GDF15 polypeptide in which at least one residue normally found at a given position of the naturally-occurring GDF15 polypeptide is deleted or is replaced by a residue not normally found at that position in the naturally-occurring GDF15 polypeptide. In some cases it will be desirable to replace a single residue normally found at a given position in the sequence of a naturally-occurring GDF15 polypeptide with more than one residue that is not normally found at the position; in still other cases it may be desirable to maintain the sequence of the naturally-occurring GDF15 polypeptide and insert one or more residues at a given position in the protein; in still other cases it may be desirable to delete a given residue entirely; all of these constructs are encompassed by the term "GDF15 mutant polypeptide."

In various embodiments, a GDF15 mutant polypeptide comprises an amino acid sequence that is at least about 85 percent identical to a naturally-occurring GDF15 polypeptide (e.g., SEQ ID NOs:4, 8 or 12). In other embodiments, a GDF15 mutant polypeptide comprises an amino acid sequence that is at least about 90 percent, or about 95, 96, 97, 98, or 99 percent identical to a naturally-occurring GDF15 polypeptide amino acid sequence (e.g., SEQ ID NOs:4, 8 or 12). Such GDF15 mutant polypeptides preferably, but need not, possess at least one activity of a naturally-occurring GDF15 polypeptide, such as the ability to lower blood glucose, insulin, triglyceride, or cholesterol levels; the ability to reduce body weight; the ability to improve glucose tolerance, lipid tolerance, or insulin sensitivity; or the ability to lower urine glucose and protein excretion.

The term "GDF15 region" encompasses GDF15 polypeptides and GDF15 mutant polypeptides and sequences as defined above.

A GDF15 polypeptide or a GDF15 mutant polypeptide is preferably biologically active. In some instances, a GDF15 polypeptide or a GDF15 mutant polypeptide used to treat or ameliorate a metabolic disorder in a subject from or derived from a different species as the subject. In some instances, a GDF15 polypeptide or a GDF15 mutant polypeptide used to treat or ameliorate a metabolic disorder in a subject from or derived from the same species as the subject.

The term "native Fc" refers to molecule or sequence comprising the sequence of a non-antigen-binding fragment resulting from digestion of whole antibody, whether in monomeric or multimeric form. The original immunoglobulin source of the native Fc is preferably of human origin and may be any of the immunoglobulins, although IgG1 and IgG2 are preferred. Native Fc's are made up of monomeric polypeptides that may be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgA1, IgA2). One example of a native Fc is a disulfide-bonded dimer resulting from papain digestion of an IgG (see Ellison et al. (1982), Nucleic Acids Res. 10: 4071-9). The term "native Fc" as used herein is generic to the monomeric, dimeric, and multimeric forms.

The term "Fc variant" refers to a molecule or sequence that is modified from a native Fc. Such modifications include, but are not limited to, one or more amino acid substitutions, including substitutions with non-naturally-occurring amino acids, non-naturally-occurring amino acid analogs and amino acid mimetics, deletions or additions. Thus, the term "Fc variant" comprises a molecule or sequence that is humanized from a non-human native Fc. Furthermore, a native Fc comprises sites that may be removed because they provide structural features or biological activity that are not required for the fusion molecules of the present invention. Thus, the term "Fc variant" comprises a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter. In various embodiments, an Fc variant comprises an amino acid sequence that is at least about 85 percent identical to a native Fc. In other embodiments, an Fc variant comprises an amino acid sequence that is at least about 90 percent, or about 95, 96, 97, 98, or 99 percent identical to a native Fc.

The term "Fc domain" encompasses native Fc and Fc variant molecules and sequences as defined above. As with Fc variants and native Fcs, the term "Fc domain" includes molecules in monomeric or multimeric form.

The term "multimer" as applied to Fc domains or molecules comprising Fc domains refers to molecules having two or more polypeptide chains associated covalently, non-covalently, or by both covalent and non-covalent interactions. IgG molecules typically form dimers; IgM, pentamers; IgD, dimers; and IgA, monomers, dimers, trimers, or tetramers. Multimers may be formed by exploiting the sequence and resulting activity of the native Ig source of the Fc or by derivatizing such a native Fc.

The term "dimer" as applied to Fc domains or molecules comprising Fc domains refers to molecules having two polypeptide chains associated covalently, non-covalently or by both covalent and non-covalent interactions.

The term "hinge" or "hinge region" herein includes the flexible polypeptide comprising the amino acids between the first and second constant domains of an antibody. The "hinge region" as referred to herein is a sequence region of 6-62 amino acids in length, only present in IgA, IgD and IgG, which encompasses the cysteine residues that bridge the two heavy chains.

The "polypeptide linker" refers to a short polypeptide, generally from 1 to 30 amino acid residues in length, that covalently links together two polypeptides, typically via peptide bonds.

As used herein, the term HSA polypeptide encompasses a naturally-occurring "wild type" human serum albumin. The term also includes various bioactive fragments and variants, fusion proteins, and modified forms of the wild type HSA protein. Such bioactive fragments or variants, fusion proteins, and modified forms of wild type HSA protein have at least a portion of the amino acid sequence of substantial sequence identity to the wild type HAS protein. In certain embodiments, such bioactive fragments or variants, fusion proteins, and modified forms of wild type HSA protein have an amino acid sequence that is at least about 85 percent identical to the wild type HSA. In other embodiments, such bioactive fragments or variants, fusion proteins, and modified forms of wild type HSA protein have an amino acid sequence that is at least about 90 percent, or about 95, 96, 97, 98, or 99 percent identical to the wild type HAS.

II. Fc Fusions Comprising GDF15 Polypeptides or GDF15 Mutant Polypeptides, and Polynucleotides A range of Fc fusion proteins comprising a GDF15 polypeptide or a GDF15 mutant polypeptide are provided herein. In some embodiments, the fusion proteins comprise a native Fc. In some embodiments, the fusion proteins comprise an Fc domain that has been engineered.

In some embodiments, the GDF15 polypeptide- (or GDF15 mutant polypeptide-) containing Fc fusion proteins associate with another polypeptide chain consisting of or comprising an Fc domain to form a heterodimer. In some embodiments, two such heterodimers associate to form a heterotetramer. Some of these polypeptide constructs (i.e., GDF15 polypeptide- (or GDF15 mutant polypeptide-) containing Fc fusion proteins and multimers comprising one or more such GDF15 polypeptide- (or GDF15 mutant polypeptide-) containing Fc fusion proteins) were studied empirically, as described in the Examples presented herein below.

Antibodies belong to the immunoglobulin class of proteins which includes IgG, IgA, IgE, IgM, and IgD. The most abundant immunoglobulin class in human serum is IgG (Deisenhofer J 1981 *Biochem* 20:2361-2370; Huber R 1984 *Behring Inst Mitt* 76:1-14; Roux K H 1999 *Int Arch Allergy Immunol* 120:85-99). The IgG structure has four chains, two light and two heavy chains; each light chain has two domains and each heavy chain has four domains. The antigen binding site is located in the Fab domain (Fragment antigen binding) which contains a variable light (VL) and a variable heavy (VH) chain domain as well as constant light (LC) and constant heavy (CH1) chain domains. The CH2 and CH3 domain region of the heavy chain is called Fc (Fragment crystallizable). The IgG molecule can be considered as a heterotetramer having two heavy chains that are held together by disulfide bonds (—S—S—) at the hinge region and two light chains. The number of hinge disulfide bonds varies among the immunoglobulin subclasses (Papadea C 1989 *Crit Rev Clin Lab Sci* 27:27-58). The FcRn binding site is located in the Fc domain of the antibody (Martin W L 2001 *Mol Cell* 7:867-877), and thus the extended serum half-life property of the antibody is retained in the Fc fragment. The Fc domain alone can be thought of as a homodimer of heavy chains comprising CH2 and CH3 domains.

In certain preferred embodiments, the fusion proteins described herein comprise an IgG Fc domain, derived from a wild-type human IgG Fc domain. By "wild-type" human IgG Fc, it is meant a sequence of amino acids that occurs naturally within the human population. Of course, just as the Fc sequences may vary slightly between individuals, one or more alterations may be made to a wild-type sequence and still remain within the scope of the invention. For example, the Fc domain may contain additional alterations that are not related to the present invention, such as a mutation in a glycosylation site or the inclusion of an unnatural amino acid. In certain embodiments, the polypeptide containing the CH3 region is an IgG molecule and further contains a CH1 and CH2 domain. Exemplary human IgG sequences comprise the constant regions of IgG1, IgG2, IgG3 and IgG4. The Fc domain also may be comprised within the constant region of an IgA, IgD, IgE, and IgM heavy chain.

Some Fc fusion proteins containing GDF15 polypeptide or GDF15 mutant polypeptide, and multimers comprising such Fc fusion proteins include those described below.

II.A. DhMonoFc Constructs

The designations "Mono-" or "MonoFc domain" in the instant disclosure refer to an Fc domain that has been engineered to reduce or prevent the formation of homodimers. In one embodiment, a MonoFc domain is provided by introducing a tyrosine to threonine mutation (Y349T) and two lysine to aspartic acid mutations (K392D and K409D) in a native Fc or Fc variant.

The C-terminal lysine (K447) optionally may be deleted in the MonoFc. This may be advantageous, for example, when a peptide is fused at the C-terminus to reduce proteolysis of the fusion protein.

A fusion protein is provided comprising a MonoFc domain and a GDF15 region. Typically, the N-terminus of the GDF15 region is linked, directly or via a polypeptide linker, to the C-terminus of the MonoFc domain. However, in some embodiments, the N-terminus of the MonoFc domain is linked, directly or via a polypeptide linker, to the C-terminus of the GDF15 region.

In certain embodiments, a dimer is provided comprising two such fusion proteins linked via an interchain disulfide bond between their respective GDF15 regions. In some embodiments the dimer is a homodimer. In other embodiments, the dimer is a heterodimer.

The designations "DhMono-" or "DhMonoFc domain" in the instant disclosure refer to an Fc domain from which all or part of the hinge region has been removed that has been engineered to reduce or prevent the formation of homodimers. In one embodiment, a DhMonoFc domain is provided introducing a tyrosine to threonine mutation (Y349T) and two lysine to aspartic acid mutations (K392D and K409D) in a native Fc or Fc variant from which all or part of the hinge region has been removed.

The C-terminal lysine (K447) optionally may be deleted in the DhMonoFc. This may be advantageous, for example, when a peptide is fused at the C-terminus to reduce proteolysis of the fusion protein.

A fusion protein is provided comprising a DhMonoFc domain and a GDF15 region. Typically, the N-terminus of the GDF15 region is linked, directly or via a polypeptide linker, to the C-terminus of the DhMonoFc domain. However, in some embodiments, the N-terminus of the DhMonoFc domain is linked, directly or via a polypeptide linker, to the C-terminus of the GDF15 region.

In certain embodiments, a dimer is provided comprising two such fusion proteins linked via an interchain disulfide bond between their respective GDF15 regions. In some embodiments the dimer is a homodimer. In other embodiments, the dimer is a heterodimer.

II.A.1 DhMonoFc-GDF15

The designation "MonoFc-GDF15" in the instant disclosure refers to a fusion protein comprising a GDF15 polypeptide, the N-terminus of which is linked directly to the C-terminus of a MonoFc domain.

In certain embodiments, a homodimer is provided comprising two such fusion proteins linked via an interchain disulfide bond between their respective GDF15 regions.

More particularly, in a specific embodiment, the homodimer comprises:

(a) two MonoFc domains (one each monomer) comprising the sequence:

(SEQ ID NO: 22)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG, and (b) two GDF15 polypeptides (one each monomer) comprising the sequence of SEQ ID NO:12.

In a preferred embodiment, the fusion protein comprises the amino acid sequence:

(SEQ ID NO: 46)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARNGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 45)
gcacctgaactcctgggggaccgtcagtcttcctcttccccc caaaacccaaggacaccctcatgatctcccggacccctgaggtcacatgc gtggtggtggacgtgagccacgaagaccctgaggtcaagttcaactggta cgtggacggcgtggaggtgcataatgccaagacaaagccgcgggaggagc agtacaacagcacgtaccgtgtggtcagcgtcctcaccgtcctgcaccag gactggctgaatggcaaggagtacaagtgcaaggtctccaacaaagccct cccagcccccatcgagaaaaccatctccaaagccaaagggcagccccgag aaccacaggtgaccaccctgcccccatcccgggaggagatgaccaagaac caggtcagcctgacctgcctggtcaaaggcttctatcccagcgacatcgc cgtggagtgggagagcaatgggcagccggagaacaactacgacaccacgc ctcccgtgctggactccgacggctccttcttcctctatagcgacctcacc gtggacaagagcaggtggcagcaggggaacgtcttctcatgctccgtgat gcatgaggctctgcacaaccactacacgcagaagagcctctccctgtctc cgggtgcgcgcaacggagaccactgtccgctcgggcccgggcgttgctgc cgtctgcacacggtccgcgcgtcgctggaagacctgggctgggccgattg ggtgctgtcgccacgggaggtgcaagtgaccatgtgcatcggcgcgtgcc cgagccagttccgggcggcaaacatgcacgcgcagatcaagacgagcctg caccgcctgaagcccgacacggtgccagcgccctgctgcgtgcccgccag ctacaatcccatggtgctcattcaaaagaccgacaccggggtgtcgctcc agacctatgatgacttgttagccaaagactgccactgcata.

As discussed above, in a specific embodiment, a homodimer is provided comprising two monomers having the sequence of SEQ ID NO:46.

II.A.2 DhMonoFc-(G₄S)₄-GDF15

The designation "DhMonoFc-(G₄S)₄-GDF15" in the instant disclosure refers to a fusion protein comprising a GDF15 polypeptide linked to a DhMonoFc domain via a polypeptide linker comprising the sequence of SEQ ID NO:18 that connects the N-terminus of the GDF15 polypeptide to the C-terminus of the DhMonoFc domain.

In certain embodiments, a homodimer is provided comprising two such fusion proteins linked via an interchain disulfide bond between their respective GDF15 regions.

More particularly, in a specific embodiment, the homodimer comprises:

(a) two DhMonoFc domains (one each monomer) comprising the sequence of SEQ ID NO:22, (b) two GDF15 polypeptides (one each monomer) comprising the sequence of SEQ ID NO:12, and (c) two polypeptide linkers (one each monomer) comprising the sequence:

GGGGSGGGGSGGGGSGGGGS (SEQ ID NO:18)

each linking the N-terminus of a GDF15 polypeptide to the C-terminus of a DhMonoFc domain.

In a preferred embodiment, the fusion protein comprises the amino acid sequence (linker sequence double underlined):

(SEQ ID NO: 24)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u><u>GGGGSGGGGSGGGGSGGGGS</u></u>ARNGDHCPLGPGRC

CRLHTVRASLEDLGWADWVLSPREVQVTMCIGACPSQFRAANMHAQIKTS

LHRLKPDTVPAPCCVPASYNPMVLIQKTDTGVSLQTYDDLLAKDCHCI, which is encoded by the nucleic acid sequence:

(SEQ ID NO: 23)
cacctgaactcctgggggaccgtcagtcttcctcttcccccaaaaccc aaggacaccctcatgatctcccggacccctgaggtcacatgcgtggtggt

```
ggacgtgagccacgaagaccctgaggtcaagttcaactggtacgtggacg gcgtggaggtgcataatgccaagacaaagccgcgggaggagcagtacaac agcacgtaccgtgtggtcagcgtcctcaccgtcctgcaccaggactggct gaatggcaaggagtacaagtgcaaggtctccaacaaagccctcccagccc ccatcgagaaaccatctccaaagccaaagggcagccccgagaaccacag gtgaccaccctgcccccatcccggaggagatgaccaagaaccaggtcag cctgacctgcctggtcaaaggcttctatcccagcgacatcgccgtggagt gggagagcaatgggcagccggagaacaactacgacaccacgcctcccgtg ctggactccgacggctccttcttcctctatagcgacctcaccgtggacaa gagcaggtggcagcaggggaacgtcttctcatgctccgtgatgcatgagg ctctgcacaaccactacacgcagaagagcctctccctgtctccgggtgga ggtggtggatccggaggcggtggaagcggaggtggtggatctggaggcgg tggaagcgcgcgcaacggagaccactgtccgctcgggcccgggcgttgct gccgtctgcacacggtccgcgcgtcgctggaagacctgggctgggccgat tgggtgctgtcgccacgggaggtgcaagtgaccatgtgcatcggcgcgtg cccgagccagttccgggcggcaaacatgcacgcgcagatcaagacgagcc tgcaccgcctgaagcccgacacggtgccagcgccctgctgcgtgcccgcc agctacaatcccatggtgctcattcaaaagaccgacaccggggtgtcgct ccagacctatgatgacttgttagccaaagactgccactgcatatga.
```

As discussed above, in a specific embodiment, a homodimer is provided comprising two monomers having the sequence of SEQ ID NO:24.

II.A.3 DhMonoFc-(G₄S)₄-GDF15(H6D)

The designation "DhMonoFc-(G₄S)₄-GDF15(H6D)" in the instant disclosure refers to fusion protein comprising a GDF15 polypeptide linked to a DhMonoFc domain via a polypeptide linker comprising the sequence of SEQ ID NO:18 that connects the N-terminus of the GDF15 polypeptide to the C-terminus of the DhMonoFc domain. The GDF15(H6D) variant is a naturally-occurring human GDF15 variant.

In certain embodiments, a homodimer is provided comprising two such fusion proteins linked via an interchain disulfide bond between their respective GDF15 regions.

More particularly, in a specific embodiment, the homodimer comprises:

(a) two DhMonoFc domains (one each monomer) comprising the sequence of SEQ ID NO:22, (b) two GDF15(H6D) polypeptides (one each monomer) comprising the sequence:

```
                                               (SEQ ID NO: 25)
ARNGDDCPLGPGRCCRLHTVRASLEDLGWADWVLSPREVQVTMCIGACPS

QFRAANMHAQIKTSLHRLKPDTVPAPCCVPASYNPMVLIQKTDTGVSLQT

YDDLLAKDCHCI,
``` and (c) two polypeptide linkers (one each monomer) comprising the sequence of SEQ ID NO:18 each linking the N-terminus of the GDF15 polypeptide to the C-terminus of the DhMonoFc domain.

In a preferred embodiment, the fusion protein comprises the amino acid sequence (linker sequence double underlined):

```
                                               (SEQ ID NO: 27)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGSGGGGSGGGGSGGGGSARNGDDCPLGPGRC

CRLHTVRASLEDLGWADWVLSPREVQVTMCIGACPSQFRAANMHAQIKTS

LHRLKPDTVPAPCCVPASYNPMVLIQKTDTGVSLQTYDDLLAKDCHCI,
``` which is encoded by the nucleic acid sequence:

```
                                               (SEQ ID NO: 26)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaccatctccaaagccaaagggcagccccgagaaccaca ggtgaccaccctgcccccatcccggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggatccggaggcggtggaagcggaggtggtggatctggaggcg gtggaagcgcgcgcaacggagacgactgtccgctcgggcccgggcgttgc tgccgtctgcacacggtccgcgcgtcgctggaagacctgggctgggccga ttgggtgctgtcgccacgggaggtgcaagtgaccatgtgcatcggcgcgt gcccgagccagttccgggcggcaaacatgcacgcgcagatcaagacgagc ctgcaccgcctgaagcccgacacggtgccagcgccctgctgcgtgcccgc cagctacaatcccatggtgctcattcaaaagaccgacaccggggtgtcgc tccagacctatgatgacttgttagccaaagactgccactgcatatga.
```

As discussed above, in a specific embodiment, a homodimer is provided comprising two monomers having the sequence of SEQ ID NO:27.

II.B. HemiFc

The designations "Hemi-" or "HemiFc domain" in the instant disclosure refer to a polypeptide chain comprising a first Fc domain linked, directly or via a polypeptide linker, to a second Fc domain. In one embodiment, the first Fc domain and the second Fc domain have the same sequence. In another embodiment, the first Fc domain and second Fc domain have different sequences. Typically, the first and second Fc domains are covalently associated via disulfide bonds between their respective hinge regions.

The C-terminal lysine (K447) optionally may be deleted in the first Fc domain, the second Fc domain, or both. This may be advantageous, for example, when a peptide is fused at the C-terminus to reduce proteolysis of the fusion protein.

A fusion protein is provided comprising a HemiFc domain and a GDF15 region. Typically, the N-terminus of the GDF15 region is linked, directly or via a polypeptide linker, to the C-terminus of the HemiFc domain. However, in some embodiments, the N-terminus of the HemiFc domain is linked, directly or via a polypeptide linker, to the C-terminus of the GDF15 region.

Figure 3:
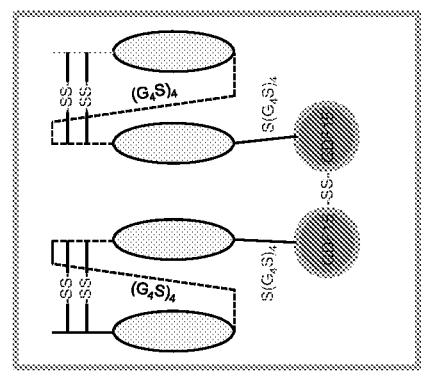
FIG. 3 is a graphic depicting a HemiFc construct comprising a dimer of two GGGFc-(G₄S)₄-Fc-S(G₄S)₄-GDF15 fusion proteins.

In certain embodiments, a dimer is provided comprising two such fusion proteins linked via an interchain disulfide bond between their respective GDF15 regions. In some embodiments the dimer is a homodimer. In other embodiments, the dimer is a heterodimer. See FIG. 3 for a graphic depiction of an embodiment of a homodimer of two GGG-Fc-($G_4S$)$_4$-Fc-S($G_4S$)$_4$-GDF15 fusion proteins.

GGGFc-($G_4S$)$_4$-Fc-S($G_4S$)$_4$-GDF15

The designation "GGGFc-($G_4S$)$_4$-Fc-S($G_4S$)$_4$-GDF15" in the instant disclosure refers to a fusion protein comprising a GDF15 polypeptide linked to HemiFc domain via a first polypeptide linker comprising the sequence of SEQ ID NO:30, that connects the N-terminus of the GDF15 polypeptide to the C-terminus of the HemiFc domain. The HemiFc domain comprises a first Fc domain linked to a second Fc domain via a polypeptide linker comprising the sequence of SEQ ID NO:18, that connects the N-terminus of the first Fc domain to the C-terminus of the second Fc domain (which has three glycine residues added to its N-terminus).

In certain embodiments, a homodimer is provided comprising two such fusion proteins linked via an interchain disulfide bond between their respective GDF15 regions.

More particularly, in a specific embodiment, the homodimer comprises:

(a) two second Fc domains (one each monomer) comprising the sequence (part of the hinge region in parentheses):

```
                                        (SEQ ID NO: 28)
GGG(ERKSSVECPPCP)APPVAGPSVFLFPPKPKDTLMISRTPEVTCVVV

DVSHEDPEVQFNWYVDGVEVHNAKTKPREEQFNSTFRVVSVLTVVHQDWL

NGKEYKCKVSNKGLPAPIEKTISKTKGQPREPQVYTLPPSREEMTKNQVS

LTCLVKGFYPSDIAVEWESNGQPENNYKTTPPMLDSDGSFFLYSKLTVDK

SRWQQGNVFSCSVMHEALHNHYTQKSLSLSPG,
```

(b) two first Fc domains (one each monomer) comprising the sequence (part of the hinge region in parentheses):

```
                                        (SEQ ID NO: 29)
(ERKSSVECPPCP)APPVAGPSVFLFPPKPKDTLMISRTPEVTCVVVDVS

HEDPEVQFNWYVDGVEVHNAKTKPREEQFNSTFRVVSVLTVVHQDWLNGK

EYKCKVSNKGLPAPIEKTISKTKGQPREPQVYTLPPSREEMTKNQVSLTC

LVKGFYPSDIAVEWESNGQPENNYKTTPPMLDSDGSFFLYSKLTVDKSRW

QQGNVFSCSVMHEALHNHYTQKSLSLSPG.
```

(c) two second polypeptide linkers (one each monomer) comprising the sequence of SEQ ID NO:18 linking the N-terminus of the first Fc domain to the C-terminus of the second Fc domain, (d) two GDF15 polypeptides (one each monomer) comprising the sequence of SEQ ID NO:12, and (e) two first polypeptide linkers (one each monomer) comprising sequence:

SGGGGSGGGGSGGGGSGGGGS (SEQ ID NO:30) linking the N-terminus of a GDF15 polypeptide to the C-terminus of a first Fc domain.

In a preferred embodiment, the fusion protein comprises the amino acid sequence (part of the hinge region in parentheses; linker sequences double underlined):

```
                                        (SEQ ID NO: 32)
GGG(ERKSSVECPPCP)APPVAGPSVFLFPPKPKDTLMISRTPEVTCVVV

DVSHEDPEVQFNWYVDGVEVHNAKTKPREEQFNSTFRVVSVLTVVHQDWL

NGKEYKCKVSNKGLPAPIEKTISKTKGQPREPQVYTLPPSREEMTKNQVS

LTCLVKGFYPSDIAVEWESNGQPENNYKTTPPMLDSDGSFFLYSKLTVDK

SRWQQGNVFSCSVMHEALHNHYTQKSLSLSPGGGGGSGGGGSGGGGSGGG

GS(ERRSSVECPPCP)APPVAGPSVFLFPPKPKDTLMISRTPEVTCVVVD

VSHEDPEVQFNWYVDGVEVHNAKTKPREEQFNSTFRVVSVLTVVHQDWLN

GKEYKCKVSNKGLPAPIEKTISKTKGQPREPQVYTLPPSREEMTKNQVSL

TCLVKGFYPSDIAVEWESNGQPENNYKTTPPMLDSDGSFFLYSKLTVDKS

RWQQGNVFSCSVMHEALHNHYTQKSLSLSPGSGGGGSGGGGSGGGGSGGG

GSARNGDHCPLGPGRCCRLHTVRASLEDLGWADWVLSPREVQVTMCIGAC

PSQFRAANMHAQIKTSLHRLKPDTVPAPCCVPASYNPMVLIQKTDTGVSL

QTYDDLLAKDCHCI,
``` which is encoded by the nucleic acid sequence:

```
                                        (SEQ ID NO: 31)
ggaggtggagagcgcaaatcttctgtcgagtgcccaccgtgcccagcacc acctgtggcaggaccgtcagtcttcctcttccccccaaaacccaaggaca ccctcatgatctcccggacccctgaggtcacgtgcgtggtggtggacgtg agccacgaagaccccgaggtccagttcaactggtacgtggacggcgtgga ggtgcataatgccaagacaaaaccacgggaggagcagttcaacagcacgt tccgtgtggtcagcgtcctcaccgttgtgcaccaggactggctgaacggc aaggagtacaagtgcaaggtctccaacaaaggcctcccagcccccatcga gaaaaccatctccaaaaccaaagggcagccccgagaaccacaggtgtaca ccctgcccccatcccgggaggagatgaccaagaaccaggtcagcctgacc tgcctggtcaaaggcttctaccccagcgacatcgccgtggagtgggagag caatgggcagccggagaacaactacaagaccacacctcccatgctggact ccgacggctccttcttcctctacagcaagctcaccgtggacaagagcagg tggcagcaggggaacgtcttctcatgctccgtgatgcatgaggctctgca caaccactacacgcagaagagcctctccctgtctccgggtggaggtggcg gtagcggtggcggaggttcaggtggcggcggaagcggtggaggaggttca gagcggaaatccagcgttgaatgtcctccgtgccctgctccacccgtcgc ggggcctagtgtcttccttttccctccaaaaccaaaggatacactgatga tcagccggaccccgaggttacgtgcgtcgtcgtcgatgtctcccacgag gatccagaggtccaattcaactggtacgtggacggggtcgaggtgcataa tgcaaagacaaagccacgggaagagcagtttaactctacttccgcgtgg tttctgtgctgaccgtggtgcaccaagattggctcaacggcaaggagtac
```

-continued

```
aagtgcaaggtaagcaataaggggctccctgcccccattgagaagactat ctccaagacaagggacagccacgcgagccacaagtctatacactccccc cttcccgcgaagaaatgaccaagaatcaggttagcctgacatgcttggtt aagggtttctaccccctctgacatagccgtggagtgggagagcaatggaca accagagaacaactacaagaccaccccacccatgctggatagcgacggtt cattctttctgtatagtaagcttaccgtggacaagtcccggtggcaacaa ggaaatgtcttttcatgctctgtgatgcacgaggccttgcataatcacta tactcagaagagcttgagcctcagcccggatctggaggtggcggatccg ggggcggtggaagcggaggtggtggatcgggaggcggtggaagcgcgcgc aacggcgaccactgtccgctcgggcccggacgttgctgccgtctgcacac ggtccgcgcgtcgctggaagacctgggctgggccgattgggtgctgtcgc cacgggaggtgcaagtgaccatgtgcatcggcgcgtgcccgagccagttc cgggcggcaaacatgcacgcgcagatcaagacgagcctgcaccgcctgaa gcccgacacggtgccagcgccctgctgcgtgcccgccagctacaatccca tggtgctcattcaaaagaccgacaccggggtgtcgctccagacctatgat gacttgttagccaaagactgccactgcatatga.
```

As discussed above, in a specific embodiment, a homodimer is provided comprising two monomers having the sequence of SEQ ID NO:32.

II.C. DhHemiFc

The designations "DhHemi-" or "DhHemiFc domain" in the instant disclosure refer to a polypeptide chain comprising a first Fc domain from which all or part of the hinge region has been removed ("DhFc" domain) linked, directly or via a polypeptide linker, to a second DhFc domain. In particular embodiments, the N-terminal 12 amino acids in the hinge region are removed, e.g., ERKSSVECPPCP (SEQ ID NO:15). In one embodiment, the first DhFc domain and the second DhFc domain have the same sequence. In another embodiment, the first DhFc domain and the second DhFc domain have different sequences.

A fusion protein is provided comprising a DhHemiFc domain and a GDF15 region. Typically, the N-terminus of the GDF15 region is linked, directly or via a polypeptide linker, to the C-terminus of the DhHemiFc domain. However, in some embodiments, the N-terminus of the DhHemiFc domain is linked, directly or via a polypeptide linker, to the C-terminus of the GDF15 region.

In certain embodiments, a dimer is provided comprising two such fusion proteins linked via an interchain disulfide bond between their respective GDF15 regions. In some embodiments the dimer is a homodimer. In other embodiments, the dimer is a heterodimer.

GGGDhFc-(G₄S)₅-DhFc-S(G₄S)₄-GDF15

The designation "GGGDhFc-(G₄S)₅-DhFc-S(G₄S)₄-GDF15" in the instant disclosure refers to a fusion protein comprising a GDF15 polypeptide linked to a DhHemiFc domain via a first polypeptide linker comprising the sequence of SEQ ID NO:30, that connects the N-terminus of the GDF15 polypeptide to the C-terminus of the HemiFc domain. The HemiFc domain comprises a first DhFc domain linked to a second DhFc domain via a polypeptide linker comprising the sequence of SEQ ID NO:34, that connects the N-terminus of the first DhFc domain to the C-terminus of the second DhFc domain (which has three glycine residues added to its N-terminus).

In certain embodiments, a homodimer is provided comprising two such fusion proteins linked via an interchain disulfide bond between their respective GDF15 regions.

More particularly, in a specific embodiment, the homodimer comprises:

(a) two second DhFc domains (one each monomer) comprising the sequence:

(SEQ ID NO: 33)
GGGAPPVAGPSVFLFPPKPKDTLMISRTPEVTCVVVDVSHEDPEVQFNWY

VDGVEVHNAKTKPREEQFNSTFRVVSVLTVVHQDWLNGKEYKCKVSNKGL

PAPIEKTISKTKGQPREPQVYTLPPSREEMTKNQVSLTCLVKGFYPSDIA

VEWESNGQPENNYKTTPPMLDSDGSFFLYSKLTVDKSRWQQGNVFSCSVM

HEALHNHYTQKSLSLSPG, (b) two first DhFc domains (one each monomer) comprising the sequence:

(SEQ ID NO: 35)
APPVAGPSVFLFPPKPKDTLMISRTPEVTCVVVDVSHEDPEVQFNWYVDG

VEVHNAKTKPREEQFNSTFRVVSVLTVVHQDWLNGKEYKCKVSNKGLPAP

IEKTISKTKGQPREPQVYTLPPSREEMTKNQVSLTCLVKGFYPSDIAVEW

ESNGQPENNYKTTPPMLDSDGSFFLYSKLTVDKSRWQQGNVFSCSVMHEA

LHNHYTQKSLSLSPG, (c) two second polypeptide linkers (one each monomer) comprising the sequence:
GGGGSGGGGSGGGGSGGGGSGGGGS (SEQ ID NO:34)
linking the N-terminus of the first DhFc domain to the C-terminus of the second DhFc domain, (d) two GDF15 polypeptides (one each monomer) comprising the sequence of SEQ ID NO:12, and (e) two first polypeptide linkers (one each monomer) comprising the sequence of SEQ ID NO:30 linking the N-terminus of a GDF15 polypeptide to the C-terminus of a first DhFc domain.

In a preferred embodiment, the fusion protein comprises the amino acid sequence (linker sequences double underlined):

(SEQ ID NO: 37)
GGGAPPVAGPSVFLFPPKPKDTLMISRTPEVTCVVVDVSHEDPEVQFNWY

VDGVEVHNAKTKPREEQFNSTFRVVSVLTVVHQDWLNGKEYKCKVSNKGL

PAPIEKTISKTKGQPREPQVYTLPPSREEMTKNQVSLTCLVKGFYPSDIA

VEWESNGQPENNYKTTPPMLDSDGSFFLYSKLTVDKSRWQQGNVFSCSVM

HEALHNHYTQKSLSLSP<u>GGGGSGGGGSGGGGSGGGGSGGGGS</u>APPVAGP

SVFLFPPKPKDTLMISRTPEVTCVVVDVSHEDPEVQFNWYVDGVEVHNAK

TKPREEQFNSTFRVVSVLTVVHQDWLNGKEYKCKVSNKGLPAPIEKTISK

TKGQPREPQVYTLPPSREEMTKNQVSLTCLVKGFYPSDIAVEWESNGQPE

NNYKTTPPMLDSDGSFFLYSKLTVDKSRWQQGNVFSCSVMHEALHNHYTQ

KSLSLSPG<u>GGGGSGGGGSGGGGSGGGGS</u>ARNGDHCPLGPGRCCRLHTVR

-continued
ASLEDLGWADWVLSPREVQVTMCIGACPSQFRAANMHAQIKTSLHRLKPD

TVPAPCCVPASYNPMVLIQKTDTGVSLQTYDDLLAKDCHCI, which is encoded by the nucleic acid sequence:

(SEQ ID NO: 36)
ggcggtggagctccgccggtggctggaccctcagtgttcctctttccacc gaagccgaaggacacccttatgattagccggaccccagaggtcacttgcg tcgtcgtggacgtgtcccatgaggatcccgaagtgcagtttaactggtat gtggacggagtggaggtccataacgccaagaccaagccaagggaagaaca gttcaatagcaccttccgggtggtgtccgtgctcaccgtggtgcatcaag actggctgaatggcaaagagtacaaatgtaaggtgtcaaacaagggctc ccagcccctattgaaaagaccatctcaaagactaagggacagccacgcga acctcaagtgtataccctcccgccttcacgcgaagaaatgactaagaatc aggtcagccttacttgtctggtcaagggcttctacccgagcgacattgca gtcgaatgggagagcaatggtcagccagagaataactacaagaccactcc tcccatgcttgatagcgatggaagcttttttcctttacagcaagcttactg tggataagtctcgctggcaacagggaaatgtgttcagctgttcagtgatg catgaagcactccacaatcattacacccagaagtcactcagcctctcacc cggaggaggaggcggttctggtggaggagggtctggaggtggagggagcg gcggaggcgggtctggcggtggtgggtctgagaggaagtcatcagtggaa tgcccaccatgcctgctcctcccgtggccggtccgagcgtgtttctctt cccacctaagcccaaggacactctgatgatctcacggactccggaagtga cttgtgtggtggtggacgtgtctcatgaggaccctgaagtgcagttcaac tggtacgtggacggcgtggaggtgcacaatgctaagaccaagcctagaga ggaacagttcaattccaccttcgcgtggtgagcgtcctgaccgtcgtgc accaggactggcttaacggaaaggaatacaagtgcaaggtgtccaacaaa ggccttccagctcccattgagaaaaccatctctaaaactaagggtcaacc aagggaacccccaagtctacaccctccctccgtctagagaagagatgacca aaaaccaggtgtccctgacctgtctggtgaagggatttacccctcagac atcgccgtggagtgggaaagcaacggacagcccgaaaacaactataagac tacccctcctatgctggactcagacggatcttttcttcctctatagcaagc tcactgtggacaaatccagatggcaacaagggaatgtgttctcatgcagc gtgatgcacgaggctcttcacaaccactatacccagaagagcctgtctct ttcacctggttccggaggtggtgggagcggaggggtggatcaggtggtg gagggtccggaggcggaggatccgcacggaatggcgaccactgtccactg ggacccggaagatgttgtcgcctccacaccgtgagggcctctctggagga ccttggctgggccgactgggtcctgtcacctcgggaggtccaagtcacca tgtgtatcggagcctgccccagccaattcagagcagcaaatatgcacgca cagattaagaccagcctgcatcggcttaaacctgatactgtgccggctcc ttgttgcgtgccagcatcttacaacccgatggtgctgatccagaaaaccg ataccggtgtctccctccagacttacgacgacctccttgcaaaggactgc cattgcatc.

As discussed above, in a specific embodiment, a homodimer is provided comprising two monomers comprising the sequence of SEQ ID NO:37.

II.D. Knob/Hole

The designations "knob-" or "knobFc domain" in the instant disclosure refer to an Fc domain comprising a "knob" mutation. The designations "hole-" or "holeFc domain" in the instant disclosure refers to a native Fc or Fc variant comprising a "hole" mutation.

"Knobs" may be created by replacing small amino acid side chains with larger ones and "holes" may be created by replacing large amino acid side chains with smaller ones. See, e.g., Ridgway J B B 1996, *Protein Eng.* 9:617-621; Merchant A M 1998, *Nature Biotech.* 16:677-681.

In one embodiment, a "knobFc" domain is provided by introducing a threonine to tryptophan mutation (T366W) in the sequence of an Fc domain. In one embodiment, a "holeFc" domain is provided by introducing a threonine to serine mutation (T366S), a leucine to alanine mutation (L368A) and a tyrosine to valine mutation (Y407V) in the sequence of an Fc domain.

The C-terminal lysine (K447) optionally may be deleted in the knobFc domain, the holeFc domain, or both. This may be advantageous, for example, when a peptide is fused at the C-terminus to reduce proteolysis of the fusion protein.

In one embodiment, a "DhknobFc" domain is provided by introducing a threonine to tryptophan mutation (T366W) in the sequence of an Fc domain from which all or part of the hinge region has been removed. In one embodiment, a "DhholeFc" domain is provided by introducing a threonine to serine mutation (T366S), a leucine to alanine mutation (L368A) and a tyrosine to valine mutation (Y407V) in the sequence of an Fc domain from which all or part of the hinge region has been removed.

The C-terminal lysine (K447) optionally may be deleted in the DhknobFc, the DhholeFc, or both. This may be advantageous, for example, when a peptide is fused at the C-terminus to reduce proteolysis of the fusion protein.

In some embodiments, a heterodimer is providing comprising (i) a first polypeptide chain comprising a GDF15 region linked to a holeFc domain directly or via a polypeptide linker and (ii) a second polypeptide chain comprising a knobFc domain. In other embodiments, a heterodimer is provided comprising (i) a first polypeptide chain comprising a GDF15 region linked to a knobFc domain, directly or via a polypeptide linker and (ii) a second polypeptide chain comprising a holeFc domain.

In some embodiments, a heterodimer is providing comprising (i) a first polypeptide chain comprising a GDF15 region linked to a DhholeFc domain directly or via a polypeptide linker and (ii) a second polypeptide chain comprising a DhknobFc domain. In other embodiments, a heterodimer is provided comprising (i) a first polypeptide chain comprising a GDF15 region linked to a DhknobFc domain, directly or via a polypeptide linker and (ii) a second polypeptide chain comprising a DhholeFc domain.

In some embodiments, a tetramer is provided comprising two such heterodimers in which the heterodimers are linked via an interchain disulfide bond between the GDF15 regions of their respective first polypeptide chains. See FIG. 1 for a graphic depiction of an embodiment of a heterotetramer comprising two heterodimers, where each heterodimer comprises (i) a first polypeptide chain comprising a GDF15 polypeptide linked to a DhknobFc domain via a polypeptide linker and (ii) a second polypeptide chain comprising a DhholeFc domain.

DhknobFc-(G₄S)₄-GDF15:DhholeFc

The designation "DhknobFc-(G₄S)₄-GDF15:DhholeFc" in the instant disclosure refers to a heterodimer comprising (i) a first polypeptide chain comprising a GDF15 polypeptide linked to a DhknobFc domain via a linker comprising the sequence of SEQ ID NO:18 that connects the N-terminus of the GDF15 polypeptide to the C-terminus of the DhknobFc domain and (ii) a polypeptide chain comprising a DhholeFc domain.

In certain embodiments, a tetramer is provided comprising a dimer of two DhknobFc-(G₄S)₄-GDF15:DhholeFc heterodimers in which the first polypeptide chains of each heterodimer are linked via an interchain disulfide bond between their respective GDF15 regions.

More particularly, in a specific embodiment, the tetramer comprises:

(a) two DhknobFc domains (one each heterodimer) comprising the sequence:

(SEQ ID NO: 16)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSRDELTKNQVSLWCLVKGFYPSDIAVE

WESNGQPENNYKTTPPVLDSDGSFFLYSKLTVDKSRWQQGNVFSCSVMHE

ALHNHYTQKSLSLSPG, (b) two DhholeFc domains (one each heterodimer) comprising the sequence:

(SEQ ID NO: 281)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSRDELTKNQVSLSCAVKGFYPSDIAVE

WESNGQPENNYKTTPPVLDSDGSFFLVSKLTVDKSRWQQGNVFSCSVMHE

ALHNHYTQKSLSLSPG, (c) two GDF15 polypeptides (one each heterodimer) comprising the sequence of SEQ ID NO:12, and (d) two polypeptide linkers (one each heterodimer) comprising the sequence of SEQ ID NO:18 each linking the N-terminus of a GDF15 polypeptide to the C-terminus of a DhknobFc domain via peptide bonds.

In a preferred embodiment, the first polypeptide chain comprises the amino acid sequence (linker sequence double underlined):

(SEQ ID NO: 20)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSRDELTKNQVSLWCLVKGFYPSDIAVE

WESNGQPENNYKTTPPVLDSDGSFFLYSKLTVDKSRWQQGNVFSCSVMHE

ALHNHYTQKSLSLSPG<u>GGGGSGGGGSGGGGSGGGGS</u>ARNGDHCPLGPGRC

CRLHTVRASLEDLGWADWVLSPREVQVTMCIGACPSQFRAANMHAQIKTS

LHRLKPDTVPAPCCVPASYNPMVLIQKTDTGVSLQTYDDLLAKDCHCI, which is encoded by the nucleic acid sequence:

(SEQ ID NO: 19)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggatgagctgaccaagaaccaggtca gcctgtggtgcctggtcaaaggcttctatcccagcgacatcgccgtggag tgggagagcaatgggcagccggagaacaactacaagaccacgcctcccgt gctggactccgacggctccttcttcctctacagcaagctcaccgtggaca agagcaggtggcagcaggggaacgtcttctcatgctccgtgatgcatgag gctctgcacaaccactacacgcagaagagcctctccctgtctccgggtgg aggtggtggatccggaggcggtggaagcggaggtggtggatctggaggcg gtggaagcgcgcgcaacggagaccactgtccgctcgggcccgggcgttgc tgccgtctgcacacggtccgcgcgtcgctggaagacctgggctgggccga ttgggtgctgtcgccacgggaggtgcaagtgaccatgtgcatcggcgcgt gcccgagccagttccgggcggcaaacatgcacgcgcagatcaagacgagc ctgcaccgcctgaagcccgacacggtgccagcgccctgctgcgtgcccgc cagctacaatcccatggtgctcattcaaaagaccgacaccggggtgtcgc tccagacctatgatgacttgttagccaaagactgccactgcatatga.

In a preferred embodiment, the second polypeptide chain comprises the amino acid sequence:

(SEQ ID NO: 17)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSRDELTKNQVSLSCAVKGFYPSDIAVE

WESNGQPENNYKTTPPVLDSDGSFFLVSKLTVDKSRWQQGNVFSCSVMHE

ALHNHYTQKSLSLSPGK, which is encoded by the nucleic acid sequence:

(SEQ ID NO: 21)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc

```
cccatcgagaaaccatctccaaagccaaagggcagccccgagaaccaca ggtgtacaccctgcccccatcccgggatgagctgaccaagaaccaggtca gcctgagctgcgcggtcaaaggcttctatcccagcgacatcgccgtggag tgggagagcaatgggcagccggagaacaactacaagaccacgcctcccgt gctggactccgacggctccttcttcctcgtcagcaagctcaccgtggaca agagcaggtggcagcagggggaacgtcttctcatgctccgtgatgcatgag gctctgcacaaccactacacgcagaagagcctctccctgtctccgggtaa atga
```

As discussed above, in a specific embodiment, a tetramer is provided comprising two monomers having the sequence of SEQ ID NO:20 and two monomers having the sequence of SEQ ID NO:17.

II.E. Charged Pair (delHinge)

The designation "CpmFc(+) domain" in the instant disclosure refers to an Fc domain comprising a "positive" charged pair mutation. The designation "CpmFc(−) domain" in the instant disclosure refers to an Fc domain comprising a "negative" charged pair mutation. Note that use of the terms "positive" and "negative" is for ease of reference (i.e., to describe the nature of the charged pair mutations in the Fc domains) and not to indicate that the overall sequence or construct necessarily has a positive or negative charge.

In one embodiment, a "positive" charged pair mutation is provided by introducing a glutamic acid to lysine mutation (E356K) and an aspartic acid to lysine mutation (D399K) in the sequence of an Fc domain. In one embodiment, a "negative" charged pair mutation is provided by introducing two lysine to aspartic acid mutations (K392D, K409D) in the sequence of an Fc domain.

When incubated together, the aspartate residues associate with the lysine residues through electrostatic force, facilitating formation of heterodimers between the CpmFc(+) domains and CpmFc(−) domains, and reducing or preventing formation of homodimers between the CpmFc(+) sequences or between CpmFc(−) sequences.

The C-terminal lysine (K447) optionally may be deleted in the CpmFc(+) domain, the CpmFc(−) domain, or both. This may be advantageous, for example, when a peptide is fused at the C-terminus to reduce proteolysis of the fusion protein.

In one embodiment, a "DhCpmFc(+)" domain is provided by introducing a glutamic acid to lysine mutation (E356K) and an aspartic acid to lysine mutation (D399K) in the sequence of an Fc domain from which all or part of the hinge region has been removed. In one embodiment, a "DhCpmFc(−)" domain is provided by introducing two lysine to aspartic acid mutations (K392D, K409D) in the sequence of an Fc domain from which all or part of the hinge region has been removed.

When incubated together, the aspartate residues associate with the lysine residues through electrostatic force, facilitating formation of heterodimers between the DhCpmFc(+) domains and DhCpmFc(−) domains, and reducing or preventing formation of homodimers between the DhCpmFc(+) sequences or between DhCpmFc(−) sequences.

The C-terminal lysine (K447) optionally may be deleted in the DhCpmFc(+), the DhCpmFc(−), or both. This may be advantageous, for example, when a peptide is fused at the C-terminus to reduce proteolysis of the fusion protein.

In some embodiments, a heterodimer is provided comprising (i) a first polypeptide chain comprising a GDF15 region linked to a CpmFc(+) domain, and (ii) a second polypeptide chain comprising a CpmFc(−) domain. In some embodiments, the N-terminus of the GDF15 region is linked to the C-terminus of the CpmFc(+) domain, directly or via a polypeptide linker. In other embodiments, the N-terminus of the CpmFc(+) domain is linked to the C-terminus of the GDF15 region, directly or via a polypeptide linker.

In other embodiments, a heterodimer is provided comprising (i) a first polypeptide chain comprising a GDF15 region linked to a CpmFc(−) domain, and (ii) a second polypeptide chain comprising a CpmFc(+) domain. In some embodiments, the N-terminus of the GDF15 region is linked to the C-terminus of the CpmFc(−) domain, directly or via a polypeptide linker. In other embodiments, the N-terminus of the CpmFc(−) domain is linked to the C-terminus of the GDF15 region, directly or via a polypeptide linker.

In some embodiments, a heterodimer is provided comprising (i) a first polypeptide chain comprising a GDF15 region linked to a DhCpmFc(+) domain, and (ii) a second polypeptide chain comprising a DhCpmFc(−) domain. In some embodiments, the N-terminus of the GDF15 region is linked to the C-terminus of the DhCpmFc(+) domain, directly or via a polypeptide linker. In other embodiments, the N-terminus of the DhCpmFc(+) domain is linked to the C-terminus of the GDF15 region, directly or via a polypeptide linker.

In other embodiments, a heterodimer is provided comprising (i) a first polypeptide chain comprising a GDF15 region linked to a DhCpmFc(−) domain, and (ii) a second polypeptide chain comprising a DhCpmFc(+) domain. In some embodiments, the N-terminus of the GDF15 region is linked to the C-terminus of the DhCpmFc(−) domain, directly or via a polypeptide linker. In other embodiments, the N-terminus of the DhCpmFc(−) domain is linked to the C-terminus of the GDF15 region, directly or via a polypeptide linker.

Figure 4:
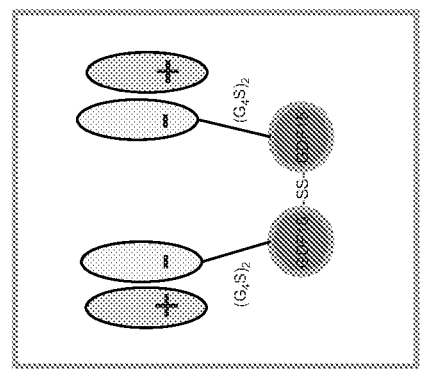
FIG. 4 is a graphic depicting a charged pair (delHinge) construct comprising a dimer of two DhCpmFc(−)-(G₄S)₂-GDF15:DhCpmFc(+) heterodimers.

In some embodiments, a tetramer is provided comprising a dimer of two such heterodimers in which the two first polypeptide chains of the heterodimers are linked via an interchain disulfide bond between their respective GDF15 regions. See FIG. 4 for a graphic depiction of an embodiment of a tetramer comprising two heterodimers, where each heterodimer comprises (i) a first polypeptide chain comprising a GDF15 polypeptide linked via a polypeptide linker to a DhCpmFc(−) domain and (ii) a second polypeptide chain comprising a DhCpmFc(+) domain.

II.E.1 DhCpmFc(+)-(1K)-GDF15:DhCpmFc(−)

The designation "DhCpmFc(+)-(1K)-GDF15:DhCpmFc(−)" in the instant disclosure refers to a heterodimer comprising (i) a first polypeptide chain comprising a GDF15 polypeptide linked to a DhCpmFc(+) domain via a linker comprising the sequence of SEQ ID NO:40 that connects the N-terminus of the GDF15 polypeptide to the C-terminus of the DhCpmFc(+) domain and (ii) a second polypeptide chain comprising a DhCpmFc(−) domain.

In certain embodiments, a tetramer is provided comprising a dimer of two DhCpmFc(+)-(1K)-GDF15:DhCpmFc(−) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence:

(SEQ ID NO: 38)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPG, (b) two DhCpmFc(−) domains (one each heterodimer) comprising the sequence:

(SEQ ID NO: 282)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPG, (c) two GDF15 polypeptides (one each heterodimer) comprising the sequence of SEQ ID NO:12, and
(d) two polypeptide linkers (one each heterodimer) comprising the sequence:
GSGSATGGSGSVASSGSGSATHL (SEQ ID NO:40)
each linking the N-terminus of a GDF15 polypeptide to the C-terminus of a DhCpmFc(+) domain via a peptide bond.

In a preferred embodiment, the first polypeptide chain comprises the amino acid sequence (linker sequence double underlined):

(SEQ ID NO: 42)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPGGSGSATGGSGSVASSGSGSATHLARNGDHCPLGP
GRCCRLHTVRASLEDLGWADWVLSPREVQVTMCIGACPSQFRAANMHAQI
KTSLHRLKPDTVPAPCCVPASYNPMVLIQKTDTGVSLQTYDDLLAKDCHC
I, which is encoded by the nucleic acid sequence:

(SEQ ID NO: 41)
gccccagagctgcttggtggaccatccgtgttcctgtttcctccaaagcc
gaaggacaccctgatgatctcaagaactccggaagtgacttgcgtcgtcg
tggacgtgtcacatgaggatccagaggtcaagttcaattggtatgtggac
ggagtggaagtgcataacgccaagaccaaaccccgcgaagaacagtacaa
tagcacctaccgcgtggtgagcgtccttactgtgctccaccaggactggc
ttaatgggaaggaatacaagtgtaaggtgtccaacaaggccctcccgct
cccatcgaaaagaccatctcaaaggcaaaggggcaaccaagggaacctca
agtgtacaccctgcctccgagcaggaaggagatgaccaagaaccaggtca
gcctgacttgtctcgtgaagggcttctatcccagcgatattgctgtggaa
tgggagtcaaatggccagcccgagaataactacaaaactaccccacccgt
gctgaaatctgatgggtccttcttccttactccaagctgaccgtggaca
agagccgctggcaacaaggcaatgtctttagctgctcagtgatgcatgag
gctctccataatcactacactcagaagtcactgtccctgtcacctggcgg
atccggttctgctactggtggttccggctccgtcgcaagctctggttcag
gcagtgcgactcatctggcacggaacggggaccattgtccctgggacct
ggtcggtgctgccggcttcacaccgtcagagcctctctggaggaccttgg
atgggctgattgggtgctgagccctcgggaggtgcaagtcaccatgtgca
tcggggcctgccctagccagttccgcgcagccaacatgcacgctcagatc
aaaacctctcttcacagactgaagcccgacaccgtgccagcaccttgctg
tgtgccggcctcttataacccatggtcctcattcagaaaaccgacaccg
gagtgtcacttcagacttacgatgacctcctggccaaggactgccactgc
ata.

In a preferred embodiment, the second polypeptide chain and comprises the amino acid sequence (SEQ ID NO: 39)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPGK, which is encoded by the nucleic acid sequence:

(SEQ ID NO: 43)
gcgccggaactgctgggcggcccgagcgtgtttctgtttccgccgaaacc
gaaagataccctgatgattagccgcacccgggaagtgacctgcgtggtgg
tggatgtgagccatgaagatccggaagtgaaatttaactggtatgtggat
ggcgtggaagtgcataacgcgaaaaccaaaccgcgcgaagaacagtataa
cagcacctatcgcgtggtgagcgtgctgaccgtgctgcatcaggattggc
tgaacggcaaagaatataaatgcaaagtgagcaacaaagcgctgccggcg
ccgattgaaaaaaccattagcaaagcgaaaggccagccgcgcgaaccgca
ggtgtataccctgccgccgagccgcgaagaaatgaccaaaaaccaggtga
gcctgacctgcctggtgaaaggcttttatccgagcgatattgcggtggaa
tgggaaagcaacggccagccggaaaacaactatgataccacccgcgt
gctggatagcgatggcagcttttttctgtatagcgatctgaccgtggata
aaagccgctggcagcagggcaacgtgtttagctgcagcgtgatgcatgaa
gcgctgcataaccattatacccagaaaagcctgagcctgagcccgggcaa
a.

As discussed above, a tetramer is provided comprising two polypeptide chains comprising the sequence of SEQ ID NO:42 and two polypeptide chains comprising the sequence of SEQ ID NO:39.

II.E.2 DhCpmFc(−)-GDF15:DhCpmFc(+)

The designation "DhCpmFc(−)-GDF15:DhCpmFc(+)" in the instant disclosure refers to a heterodimer comprising (i)

a first polypeptide chain comprising a GDF15 polypeptide, the N-terminus of which is linked directly to the C-terminus of a DhCpmFc(−) domain, and (ii) a second polypeptide chain comprising a DhCpmFc(+) domain.

In certain embodiments, a tetramer is provided comprising a dimer of two DhCpmFc(−)-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the amino acid sequence:

```
                                            (SEQ ID NO: 283)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPG,
```

(b) two DhCpmFc(−) domains (one each heterodimer) comprising the amino acid sequence:

```
                                            (SEQ ID NO: 48)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPG,
```
and, (c) two GDF15 polypeptides (one each heterodimer) comprising the sequence of SEQ ID NO:12.

In a preferred embodiment, the first polypeptide chain comprises the amino acid sequence:

```
                                            (SEQ ID NO: 50)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPGARNGDHCPLGPGRCCRLHTVRASLEDLGWADWVL
SPREVQVTMCIGACPSQFRAANMHAQIKTSLHRLKPDTVPAPCCVPASYN
PMVLIQKTDTGVSLQTYDDLLAKDCHCI,
``` which is encoded by the nucleic acid sequence:

```
                                            (SEQ ID NO: 49)
gcacctgaactcctgggggaccgtcagtcttcctcttcccccaaaacc
caaggacaccctcatgatctcccggacccctgaggtcacatgcgtggtgg
tggacgtgagccacgaagaccctgaggtcaagttcaactggtacgtggac
ggcgtggaggtgcataatgccaagacaaagccgcgggaggagcagtacaa
cagcacgtaccgtgtggtcagcgtcctcaccgtcctgcaccaggactggc
tgaatggcaaggagtacaagtgcaaggtctccaacaaagccctcccagcc
cccatcgagaaaaccatctccaaagccaaagggcagccccgagaaccaca
ggtgtacaccctgcccccatcccgggaggagatgaccaagaaccaggtca
gcctgacctgcctggtcaaaggcttctatcccagcgacatcgccgtggag
tgggagagcaatgggcagccggagaacaactacgacaccacgcctcccgt
gctggactccgacggctccttcttcctctatagcgacctcaccgtggaca
agagcaggtggcagcaggggaacgtcttctcatgctccgtgatgcatgag
gctctgcacaaccactacacgcagaagagcctctccctgtctccgggtgc
gcgcaacggagaccactgtccgctcgggcccgggcgttgctgccgtctgc
acacggtccgcgcgtcgctggaagacctgggctgggccgattgggtgctg
tcgccacgggaggtgcaagtgaccatgtgcatcggcgcgtgcccgagcca
gttccgggcggcaaacatgcacgcgcagatcaagacgagcctgcaccgcc
tgaagcccgacacggtgccagcgccctgctgcgtgcccgccagctacaat
cccatggtgctcattcaaaagaccgacaccggggtgtcgctccagaccta
tgatgacttgttagccaaagactgccactgcata.
```

In a preferred embodiment, the second polypeptide chain comprises the amino acid sequence:

```
                                            (SEQ ID NO: 47)
APELLGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPGK,
``` which is encoded by the nucleic acid sequence:

```
                                            (SEQ ID NO: 51)
gcacctgaactcctgggggaccgtcagtcttcctcttcccccaaaacc
caaggacaccctcatgatctcccggacccctgaggtcacatgcgtggtgg
tggacgtgagccacgaagaccctgaggtcaagttcaactggtacgtggac
ggcgtggaggtgcataatgccaagacaaagccgcgggaggagcagtacaa
cagcacgtaccgtgtggtcagcgtcctcaccgtcctgcaccaggactggc
tgaatggcaaggagtacaagtgcaaggtctccaacaaagccctcccagcc
cccatcgagaaaaccatctccaaagccaaagggcagccccgagaaccaca
ggtgtacaccctgcccccatcccggaaggagatgaccaagaaccaggtca
gcctgacctgcctggtcaaaggcttctatcccagcgacatcgccgtggag
tgggagagcaatgggcagccggagaacaactacaagaccacgcctcccgt
gctgaagtccgacggctccttcttcctctatagcaagctcaccgtggaca
agagcaggtggcagcaggggaacgtcttctcatgctccgtgatgcatgag
gctctgcacaaccactacacgcagaagagcctctccctgtctccgggtaa
atga.
```

As discussed above, a tetramer is provided comprising two polypeptide chains having the sequence of SEQ ID NO:50 and two polypeptide chains having the sequence of SEQ ID NO:47.

II.E.3 DhCpmFc(−)-GDF15(N3D):DhCpmFc(+)

The designation "DhCpmFc(−)-GDF15(N3D):DhCpmFc(+)" in the instant disclosure refers to a heterodimer comprising (i) a first polypeptide chain comprising a naturally-occurring variant of a GDF15 having an asparagine to aspartic acid mutation (N3D) ("GDF15(N3D)"), the N-terminus of which is linked directly to the C-terminus of a DhCpmFc(−) domain, and (ii) a second polypeptide chain comprising a DhCpmFc(+) domain. The N3D mutation may reduce deamidation induced heterogeneity.

In certain embodiments, a tetramer is provided comprising a dimer of two DhCpmFc(−)-GDF15(N3D):DhCpmFc(+) heterodimers in which the two first polypeptide chains of each heterodimer are linked via an interchain disulfide bond between their respective GDF15 regions.

More particularly, in a specific embodiment, the tetramer comprises:
  (a) two DhCpmFc(+) domains (one each heterodimer) having the sequence of SEQ ID NO:283,
  (b) two DhCpmFc(−) domains (one each heterodimer) having the sequence of SEQ ID NO:48, and
  (c) two GDF15(N3D) polypeptides (one each heterodimer) comprising the sequence:

(SEQ ID NO: 52)
ARDGDHCPLGPGRCCRLHTVRASLEDLGWADWVLSPREVQVTMCIGACPS

QFRAANMHAQIKTSLHRLKPDTVPAPCCVPASYNPMVLIQKTDTGVSLQT

YDDLLAKDCHCI.

In a preferred embodiment, the first polypeptide chain comprises the amino acid sequence:

(SEQ ID NO: 54)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 53)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:54 and two polypeptide chains having the sequence of SEQ ID NO:47.

II.E.4 DhCpmFc(−)-GDF15(Ndel3):DhCpmFc(+)

The designation "DhCpmFc(−)-GDF15(Ndel3):DhCpmFc(+)" in the instant disclosure refers to a heterodimer comprising (i) a first polypeptide chain comprising a variant of GDF15 in which the first three amino acids are deleted ("GDF15(Ndel3)"), the N-terminus of which is linked directly to the C-terminus of a DhCpmFc(−) domain, and (ii) a second polypeptide chain comprising a DhCpmFc(+) domain. The Ndel3 variant may reduce N3 deamidation and subsequent D3 isomerization induced heterogeneity.

In certain embodiments, a tetramer is provided, comprising a dimer of two DhCpmFc(−)-GDF15(Ndel3):DhCpmFc(+) heterodimers in which the two first polypeptide chains of each heterodimer are linked via an interchain disulfide bond between their respective GDF15 regions.

More particularly, in a specific embodiment, the tetramer comprises:
  (a) two DhCpmFc(+) domains (one each heterodimer) having the sequence of SEQ ID NO:283,
  (b) two DhCpmFc(−) domains (one each heterodimer) having the sequence of SEQ ID NO:48, and
  (c) two GDF15(Ndel3) polypeptides (one each heterodimer) having the sequence:

(SEQ ID NO: 55)
GDHCPLGPGRCCRLHTVRASLEDLGWADWVLSPREVQVTMCIGACPSQFR

AANMHAQIKTSLHRLKPDTVPAPCCVPASYNPMVLIQKTDTGVSLQTYDD

LLAKDCHCI.

In a preferred embodiment, the first polypeptide chain comprises the amino acid sequence:

(SEQ ID NO: 57)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

-continued

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGDHCPLGPGRCCRLHTVRASLEDLGWADWVLSPR

EVQVTMCIGACPSQFRAANMHAQIKTSLHRLKPDTVPAPCCVPASYNPMV

LIQKTDTGVSLQTYDDLLAKDCHCI, which is encoded by the nucleic acid sequence:

(SEQ ID NO: 56)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggcccggcgttgctgccgtctgcacacggtcc gcgcgtcgctggaagacctgggctgggccgattgggtgctgtcgccacgg gaggtgcaagtgaccatgtgcatcggcgcgtgcccgagccagttccggc ggcaaacatgcacgcgcagatcaagacgagcctgcaccgcctgaagcccg acacggtgccagcgccctgctgcgtgcccgccagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence of SEQ ID NO:47, which is encoded by the nucleic acid sequence of SEQ ID NO:51.

As discussed above, a tetramer is provide comprising two polypeptide chains having the sequence of SEQ ID NO:57 and two polypeptide chains having the sequence of SEQ ID NO:47.

II.E.5 DhCpmFc(−)-G$_4$-GDF15(N3D):DhCpmFc(+)

The designation "DhCpmFc(−)-G$_4$-GDF15(N3D):DhCpmFc(+)" in the instant disclosure refers to a heterodimer comprising (i) a first polypeptide chain comprising a GDF15 (N3D) polypeptide linked to a DhCpmFc(−) domain via a linker comprising the sequence of SEQ ID NO:58 that connects the N-terminus of the GDF15(N3D) polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-G$_4$-GDF15(N3D):DhCpmFc(+) heterodimers in which the two first polypeptide chains of each heterodimer are linked via an interchain disulfide bond between their respective GDF15 regions.

More particularly, in a specific embodiment, the tetramer comprises:
(a) two DhCpmFc(+) domains (one each heterodimer) having the sequence of SEQ ID NO:283,
(b) two DhCpmFc(+) domains (one each heterodimer) having the sequence of SEQ ID NO:48,
(c) two a GDF15(N3D) polypeptides (one each heterodimer) having the sequence of SEQ ID NO:52, and
(d) two polypeptide linkers (one each heterodimer) comprising the sequence:
GGGG (SEQ ID NO:58)
each linking the N-terminus of a GDF15(N3D) polypeptide to the C-terminus of a DhCpmFc(−) domain via peptide bonds.

In a preferred embodiment, the first polypeptide comprises the amino acid sequence (linker sequence double underlined):

(SEQ ID NO: 60)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u><u>GGGG</u></u>ARDGDHCPLGPGRCCRLHTVRASLEDLGWA

DWVLSPREVQVTMCIGACPSQFRAANMHAQIKTSLHRLKPDTVPAPCCVP

ASYNPMVLIQKTDTGVSLQTYDDLLAKDCHCI, which is encoded by the nucleic acid sequence:

(SEQ ID NO: 59)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggagcgcgcgacggagaccactgtccgctcgggcccgggcgtt gctgccgtctgcacacggtccgcgcgtcgctggaagacctgggctgggcc gattgggtgctgtcgccacgggaggtgcaagtgaccatgtgcatcggcgc gtgcccgagccagttccgggcggcaaacatgcacgcgcagatcaagacga gcctgcaccgcctgaagcccgacacggtgccagcgcctgctgcgtgccc gccagctacaatcccatggtgctcattcaaaagaccgacaccggggtgtc gctccagacctatgatgacttgttagccaaagactgccactgcata.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:60 and two polypeptide chains having the sequence of SEQ ID NO:47.

II.E.6 DhCpmFc(−)-G$_4$S-GDF15:DhCpmFc(+)

The designation "DhCpmFc(−)-G$_4$S-GDF15:DhCpmFc(+)" in the instant disclosure refers to a heterodimer comprising (i) a first polypeptide chain comprising a GDF15 polypeptide linked to a DhCpmFc(−) domain via a polypeptide linker comprising the sequence of SEQ ID NO:61 that connects the N-terminus of the GDF15 polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-G$_4$S-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283,
(b) two DhCpmFc(−) domains (one each heterodimer) comprising the sequence of SEQ ID NO:48,
(c) two GDF15 polypeptides (one each heterodimer) comprising the sequence of SEQ ID NO:12, and
(d) two polypeptide linkers (one each heterodimer) comprising the sequence:
GGGGS (SEQ ID NO:61)
each linking the N-terminus of a GDF15 polypeptide to the C-terminus of a DhCpmFc(−) domain via peptide bonds.

In a preferred embodiment, the first polypeptide comprises the amino acid sequence (linker double underlined):

(SEQ ID NO: 63)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGS</u>ARNGDHCPLGPGRCCRLHTVRASLEDLGW

ADWVLSPREVQVTMCIGACPSQFRAANMHAQIKTSLHRLKPDTVPAPCCV

PASYNPMVLIQKTDTGVSLQTYDDLLAKDCHCI, which is encoded by the nucleic acid sequence:

(SEQ ID NO: 62)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggatccgcgcgcaacggagaccactgtccgctcgggcccgggc gttgctgccgtctgcacacggtccgcgcgtcgctggaagacctgggctgg gccgattgggtgctgtcgccacgggaggtgcaagtgaccatgtgcatcgg cgcgtgcccgagccagttccgggcggcaaacatgcacgcgcagatcaaga cgagcctgcaccgcctgaagcccgacacggtgccagcgccctgctgcgtg cccgccagctacaatcccatggtgctcattcaaaagaccgacaccgggt gtcgctccagacctatgatgacttgttagccaaagactgccactgcatat ga.

In a preferred embodiment, the second polypeptide comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:63 and two polypeptide chains having the sequence of SEQ ID NO:47.

II.E.7 DhCpmFc(−)-(G$_4$S)$_2$-GDF15:DhCpmFc(+)

The designation "DhCpmFc(−)-(G$_4$S)$_2$-GDF15:DhCpmFc(+)" in the instant disclosure refers to a heterodimer comprising (i) a first polypeptide chain comprising a GDF15 polypeptide linked to a DhCpmFc(−) domain via a polypeptide linker comprising the sequence of SEQ ID NO:64 that connects N-terminus of the GDF15 polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$S)$_2$-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283,
(b) two DhCpmFc(−) domains (one each heterodimer) comprising the sequence of SEQ ID NO:48,
(c) two GDF15 polypeptides (one each heterodimer) comprising the sequence of SEQ ID NO:12, and
(d) two polypeptide linkers (one each heterodimer) comprising the sequence:
GGGGSGGGGS (SEQ ID NO:64),
each linking the N-terminus of a GDF15 polypeptide to the C-terminus of a DhCpmFc(−) sequence via a peptide bond.

In a preferred embodiment, the first polypeptide chain comprises the amino acid sequence (linker double underlined):

(SEQ ID NO: 66)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

-continued

```
PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGGSGGGGSARNGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI,
``` which is encoded by the nucleic acid sequence:

```
                                    (SEQ ID NO: 65)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcagggaacgtcttctcatgctccgtgatgcatgag gctctgcacaaccactacacgcagaagagcctctccctgtctccgggtgg aggtggtggatccggaggcggtggaagcgcgcgcaacggagaccactgtc cgctcgggcccgggcgttgctgccgtctgcacacggtccgcgcgtcgctg gaagacctgggctgggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcata.
```

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains comprising the sequence of SEQ ID NO:66 and two polypeptide chains comprising the sequence of SEQ ID NO:47.

II.E.8 DhCpmFc(−)-(G$_4$S)$_2$-GDF15(N3D):DhCpmFc(+)

The designation "DhCpmFc(−)-(G$_4$S)$_2$-GDF15(N3D): DhCpmFc(+)" in the instant disclosure refers to a heterodimer comprising (i) a first polypeptide chain comprising a GDF15(N3D) polypeptide linked to a DhCpmFc(−) domain via a linker comprising the sequence of SEQ ID NO:64 that connects the N-terminus of the GDF15(N3D) polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$S)$_2$-GDF15(N3D): DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15(N3D) polypeptides (one each heterodimer) comprising the sequence of SEQ ID NO:52, and (d) two polypeptide linkers (one each heterodimer) comprising the sequence of SEQ ID NO:64, each linking the N-terminus of a GDF15(N3D) polypeptide to the C-terminus of a DhCpmFc(−) domain via a peptide bond.

In a preferred embodiment, the first polypeptide chain comprises the amino acid sequence (linker sequence double underlined):

```
                                    (SEQ ID NO: 68)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGGSGGGGSARDGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI,
``` which is encoded by the nucleic acid sequence:

```
                                    (SEQ ID NO: 67)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcagggaacgtcttctcatgctccgtgatgcatgag gctctgcacaaccactacacgcagaagagcctctccctgtctccgggtgg aggtggtggatccggaggcggtggaagcgcgcgcgacggagaccactgtc cgctcgggcccgggcgttgctgccgtctgcacacggtccgcgcgtcgctg gaagacctgggctgggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa
```

-continued

```
gaccgacaccggggtgtcgctccagacctatgatgacttgttagccaaag actgccactgcata.
```

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:68 and two polypeptide chains having the sequence of SEQ ID NO:47.

II.E.9 DhCpmFc(−)-G$_4$P-GDF15:DhCpmFc(+)

The designation "DhCpmFc(−)-(G$_4$P)-GDF15:DhCpmFc(+)" in the instant disclosure refers to a heterodimer comprising (i) a first polypeptide chain comprising a GDF15 polypeptide linked to a DhCpmFc(−) domain via a linker comprising the sequence of SEQ ID NO:69 that connects the N-terminus of the GDF15 polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$P)-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15 polypeptides (one each heterodimer) comprising the sequence of SEQ ID NO:12, and (d) two polypeptide linkers (one each heterodimer) comprising the sequence:
GGGGP (SEQ ID NO:69),
each linking the N-terminus of a GDF15 polypeptide to the C-terminus of a DhCpmFc(−) domain via a peptide bond.

In a preferred embodiment, the first polypeptide chain comprises the amino acid sequence (linker sequence double underlined):

```
                                             (SEQ ID NO: 71)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGPARNGDHCPLGPGRCCRLHTVRASLEDLGW

ADWVLSPREVQVTMCIGACPSQFRAANMHAQIKTSLHRLKPDTVPAPCCV

PASYNPMVLIQKTDTGVSLQTYDDLLAKDCHCI,
``` which is encoded by the nucleic acid sequence:

```
                                             (SEQ ID NO: 70)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggacccgcgcgcaacggagaccactgtccgctcgggcccgggc gttgctgccgtctgcacacggtccgcgcgtcgctggaagacctgggctgg gccgattgggtgctgtcgccacgggaggtgcaagtgaccatgtgcatcgg cgcgtgcccgagccagttccgggcggcaaacatgcacgcgcagatcaaga cgagcctgcaccgcctgaagcccgacacggtgccagcgccctgctgcgtg ccgccagctacaatcccatggtgctcattcaaaagaccgacaccggggt gtcgctccagacctatgatgacttgttagccaaagactgccactgcata.
```

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:71 and two polypeptide chains having the sequence of SEQ ID NO:47.

II.E.10 DhCpmFc(−)-(G$_4$P)$_2$-GDF15:DhCpmFc(+)

The designation "DhCpmFc(−)-(G$_4$P)$_2$-GDF15:DhCpmFc(+)" in the instant disclosure refers to a heterodimer comprising (i) a first polypeptide chain comprising a GDF15 polypeptide linked to a DhCpmFc(−) domain via a linker comprising the sequence of SEQ ID NO:72 that connects the N-terminus of the GDF15 polypeptide to the C-terminus of the DhCpmFc(−) domain and (ii) a second v comprising a DhCpmFc(+) sequence.

In certain embodiments, a tetramer is provided, comprising a dimer of two DhCpmFc(−)-(G$_4$P)$_2$-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15 polypeptides (one each heterodimer) comprising the sequence of SEQ ID NO:12, and (d) two polypeptide linkers (one each heterodimer) comprising the sequence:
GGGGPGGGGP (SEQ ID NO:72),
each linking the N-terminus of a GDF15 polypeptide to the C-terminus of a DhCpmFc(−) domain via a peptide bond.

In a preferred embodiment, the first polypeptide chain comprises the amino acid sequence (linker sequence double underlined):

(SEQ ID NO: 74)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGPGGGGP</u>ARNGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI, which is encoded by the nucleic acid sequence:

(SEQ ID NO: 73)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggacctggaggcggtggaccagcgcgcaacggagaccactgtc cgctcgggcccgggcgttgctgccgtctgcacacggtccgcgcgtcgctg gaagacctgggctggccgattgggtgctgtcgcacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcatatga.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:74 and two polypeptide chains comprising the sequence of SEQ ID NO:47.

II.E.11 DhCpmFc(−)-G₄Q-GDF15:DhCpmFc(+)

The designation "DhCpmFc(−)-G₄Q-GDF15:DhCpmFc(+)" in the instant disclosure refers to a heterodimer comprising (i) a first polypeptide chain comprising a GDF15 polypeptide linked to a DhCpmFc(−) domain via a linker comprising the sequence of SEQ ID NO:75 that connects the N-terminus of the GDF15 polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-G₄Q-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:
(a) two DhCpmFc(+) chains (one each heterodimer) comprising the sequence of SEQ ID NO:283,
(b) two DhCpmFc(−) chains (one each heterodimer) comprising the sequence of SEQ ID NO:48,
(c) two GDF15 polypeptides (one each heterodimer) comprising the sequence of SEQ ID NO:12, and
(d) two polypeptide linkers (one each heterodimer) comprising the sequence:
GGGGQ (SEQ ID NO:75)
each linking the N-terminus of a GDF15 polypeptide to the C-terminus of a DhCpmFc(−) domain via a peptide bond.

In a preferred embodiment, the first polypeptide chain comprises the amino acid sequence (linker sequence double underlined):

(SEQ ID NO: 77)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGQ</u>ARNGDHCPLGPGRCCRLHTVRASLEDLGW

ADWVLSPREVQVTMCIGACPSQFRAANMHAQIKTSLHRLKPDTVPAPCCV

PASYNPMVLIQKTDTGVSLQTYDDLLAKDCHCI, which is encoded by the nucleic acid sequence:

(SEQ ID NO: 76)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcactgtggaca agagcaggtggcagcaggggaacgtcttctcatgctccgtgatgcatgag gctctgcacaaccactacacgcagaagagcctctccctgtctccgggtgg aggtggtggacaggcgcgcaacggagaccactgtccgctcgggcccgggc gttgctgccgtctgcacacggtccgcgcgtcgctggaagacctgggctgg gccgattgggtgctgtcgccacgggaggtgcaagtgaccatgtgcatcgg cgcgtgcccgagccagttccgggcggcaaacatgcacgcgcagatcaaga -continued
cgagcctgcaccgcctgaagcccgacacggtgccagcgccctgctgcgtg cccgccagctacaatcccatggtgctcattcaaaagaccgacaccggggt gtcgctccagacctatgatgacttgttagccaaagactgccactgcatat ga.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:77 and two polypeptide chains having the sequence of SEQ ID NO:47.

II.E.12 DhCpmFc(−)-(G$_4$Q)$_2$-GDF15:DhCpmFc(+)

The designation "DhCpmFc(−)-(G$_4$Q)$_2$-GDF15:DhCpmFc(+)" in the instant disclosure refers to a heterodimer comprising (i) a first polypeptide chain comprising a GDF15 polypeptide linked to a DhCpmFc(−) domain via a linker comprising the sequence of SEQ ID NO:78 that connects the N-terminus of the GDF15 polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$Q)$_2$-GDF15:DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15 polypeptides (one each heterodimer) comprising the sequence of SEQ ID NO:12, and (d) two polypeptide linkers (one each heterodimer) comprising the sequence:
GGGGQGGGGQ (SEQ ID NO:78)
each linking the N-terminus of a GDF15 polypeptide to the C-terminus of a DhCpmFc(−) domain via a peptide bond.

In a preferred embodiment, the first polypeptide chain comprises the amino acid sequence (linker sequence double underlined):

(SEQ ID NO: 80)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGQGGGGQARNGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI, which is encoded by the nucleic acid sequence:

(SEQ ID NO: 79)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggacagggaggcggtggacaggcgcgcaacggagaccactgtc cgctcgggcccgggcgttgctgccgtctgcacacggtccgcgcgtcgctg gaagacctgggctgggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcatatga.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:80 and two polypeptide chains having the sequence of SEQ ID NO:47.

II.E.13 DhCpmFc(−)-(G$_4$Q)$_2$-GDF15(N3D):DhCpmFc(+)

The designation "DhCpmFc(−)-(G$_4$Q)$_2$-GDF15(N3D):DhCpmFc(+)" in the instant disclosure refers to a heterodimer comprising (i) a first polypeptide chain comprising a GDF15(N3D) polypeptide linked to a DhCpmFc(−) domain via a linker comprising the sequence of SEQ ID NO:78 that connects the N-terminus of the GDF15(N3D) polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$Q)$_2$-GDF15(N3D):DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15(N3D) polypeptides (one each heterodimer) comprising the sequence of SEQ ID NO:52, and (d) two polypeptide linkers (one each heterodimer) comprising the sequence of SEQ ID NO:78 each linking the N-terminus of a GDF15(N3D) polypeptide to the C-terminus of a DhCpmFc(−) domain via a peptide bond.

In a preferred embodiment, the first polypeptide chain comprises the amino acid sequence (linker sequence double underlined):

(SEQ ID NO: 82)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGQGGGGQ</u>ARDGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI, which is encoded by the nucleic acid sequence:

(SEQ ID NO: 81)
gcacctgaactcctgggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggacagggaggcggtggacaggcgcgcgacggagaccactgtc cgctcgggcccgggcgttgctgccgtctgcacacggtccgcgcgtcgctg gaagacctgggctggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcata.

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:82 and two polypeptide chains having the sequence of SEQ ID NO:47.

II.E.14 DhCpmFc(−)-(G$_4$Q)$_2$-GDF15(Ndel3):DhCpmFc(+)

The designation "DhCpmFc(−)-(G$_4$Q)$_2$-GDF15(Ndel3):DhCpmFc(+)" in the instant disclosure refers to a heterodimer comprising (i) a first polypeptide chain comprising a GDF15(Ndel3) polypeptide linked to a DhCpmFc(−) domain via a linker comprising the sequence of SEQ ID NO:78 that connects the N-terminus of the GDF15(Ndel3) polypeptide to the C-terminus of the DhCpmFc(−) domain and (ii) a second polypeptide chain comprising a DhCpmFc(+) domain.

In certain embodiments, a tetramer is provided, comprising a dimer of two DhCpmFc(−)-(G$_4$Q)$_2$-GDF15(Ndel3):DhCpmFc(+) heterodimers in which the two first polypeptide chains of each heterodimer are linked via an interchain disulfide bond between their respective GDF15 regions.

More particularly, in a specific embodiment, the tetramer comprises:

(a) two DhCpmFc(+) domains (one each heterodimer) comprising the sequence of SEQ ID NO:283, (b) two DhCpmFc(−) domains (one each heterodimer) comprising the sequence of SEQ ID NO:48, (c) two GDF15(Ndel3) polypeptides (one each heterodimer) comprising the sequence of SEQ ID NO:55, and (d) two polypeptide linkers (one each heterodimer) comprising the sequence of SEQ ID NO:78 each linking the N-terminus of a GDF15(Ndel3) polypeptide to the C-terminus of a DhCpmFc(−) domain via a peptide bond.

In a preferred embodiment, the first polypeptide chain comprises the amino acid sequence (linker sequence double underlined):

(SEQ ID NO: 84)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGQGGGGQ</u>GDHCPLGPGRCCRLHTVRASLEDL

GWADWVLSPREVQVTMCIGACPSQFRAANMHAQIKTSLHRLKPDTVPAPC

CVPASYNPMVLIQKTDTGVSLQTYDDLLAKDCHCI, which is encoded by the nucleic acid sequence:

(SEQ ID NO: 83)
gcacctgaactcctgggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggacagggaggcggtggacagggagaccactgtccgctcgggc ccgggcgttgctgccgtctgcacacggtccgcgcgtcgctggaagacctg -continued

```
ggctgggccgattgggtgctgtcgccacgggaggtgcaagtgaccatgtg catcggcgcgtgcccgagccagttccgggcggcaaacatgcacgcgcaga tcaagacgagcctgcaccgcctgaagcccgacacggtgccagcgccctgc tgcgtgcccgccagctacaatcccatggtgctcattcaaaagaccgacac cggggtgtcgctccagacctatgatgacttgttagccaaagactgccact gcata.
```

In a preferred embodiment, the second polypeptide chain comprises the amino acid sequence of SEQ ID NO:47, which is encoded by the nucleic acid sequence of SEQ ID NO:51.

As discussed above, a tetramer is provided comprising two polypeptide chains having the sequence of SEQ ID NO:84 and two polypeptide chains having the sequence of SEQ ID NO:47.

II.F. Charged Pair (delHinge) Cysteine Clamp

A "cysteine clamp" mutation may be introduced into a Fc domain, such as a CpmFc(+) domain, a CpmFc(−) domain, a DhCpmFc(+) domain, or a DhCpmFc(−) domain. A "cysteine clamp" mutation typically involves the introduction of a cysteine into the CH3 domain of an Fc domain at a specific location through mutation so that when incubated with another Fc domain, also having a cysteine introduced into the CH3 domain at a specific location through mutation, a disulfide bond (cysteine clamp) may be formed between the two Fc domains (e.g., between a CpmFc(+) domain having a "cysteine clamp" mutation and a CpmFc(−) domain having a "cysteine clamp" mutation or between a DhCpmFc(+) domain having a "cysteine clamp" mutation and a DhCpmFc(−) domain having a "cysteine clamp" mutation). An Fc domain may contain one or more such cysteine clamp mutations.

In one embodiment, a cysteine clamp is provided by introducing a serine to cysteine mutation (S354C) into a first Fc domain and a tyrosine to cysteine mutation (Y349C) into a second Fc domain.

The designation "DhCpmFc(−)(S354C)" domain in the instant disclosure refers to an DhCpmFc(−) domain comprising a serine to cysteine mutation (S354C). The designation "DhCpmFc(+)(S354C)" domain in the instant disclosure refers to an DhCpmFc(+) domain comprising a serine to cysteine mutation (S354C). The designation "DhCpmFc(−)(Y349C)" domain in the instant disclosure refers to an DhCpmFc(−) domain comprising a serine to cysteine mutation (Y349C). The designation "DhCpmFc(+)(Y349C)" domain in the instant disclosure refers to an DhCpmFc(+) domain comprising a serine to cysteine mutation (Y349C).

The designation "CpmFc(−)(S354C)" domain in the instant disclosure refers to an CpmFc(−) domain comprising a serine to cysteine mutation (S354C). The designation "CpmFc(+)(S354C)" domain in the instant disclosure refers to an CpmFc(+) domain comprising a serine to cysteine mutation (S354C). The designation "CpmFc(−)(Y349C)" domain in the instant disclosure refers to an CpmFc(−) domain comprising a serine to cysteine mutation (Y349C). The designation "CpmFc(+)(Y349C)" domain in the instant disclosure refers to an CpmFc(+) domain comprising a serine to cysteine mutation (Y349C).

In another embodiment, a cysteine clamp is provided by introducing a leucine to cysteine mutation (L351C) into both a first and Fc domain.

The designation "DhCpmFc(−)(L351C)" domain in the instant disclosure refers to an DhCpmFc(−) domain comprising a serine to cysteine mutation (L351C). The designation "DhCpmFc(+)(L351C)" domain in the instant disclosure refers to an DhCpmFc(+) domain comprising a serine to cysteine mutation (L351C).

The designation "CpmFc(−)(L351C)" domain in the instant disclosure refers to an CpmFc(−) domain comprising a serine to cysteine mutation (L351C). The designation "CpmFc(+)(L351C)" domain in the instant disclosure refers to an CpmFc(+) domain comprising a serine to cysteine mutation (L351C).

The C-terminal lysine (K447) optionally may be deleted in the CpmFc(+) domain, the CpmFc(−) domain, or both. This may be advantageous, for example, when a peptide is fused at the C-terminus to reduce proteolysis of the fusion protein.

In some embodiments a heterodimer is provided comprises (i) a first polypeptide chain comprising a GDF15 region linked to a CpmFc(+) domain comprising a cysteine clamp mutation and (ii) a second polypeptide chain comprising a CpmFc(−) domain comprising a cysteine clamp mutation. In some embodiments, the N-terminus of the GDF15 region is linked to the C-terminus of the CpmFc(+) domain comprising a cysteine clamp mutation, directly or via a polypeptide linker. In other embodiments, the N-terminus of the CpmFc(+) domain comprising a cysteine clamp mutation is linked to the C-terminus of the GDF15 region, directly or via a polypeptide linker.

In some embodiments a heterodimer is provided comprises (i) a first polypeptide chain comprising a GDF15 region linked to a CpmFc(−) domain comprising a cysteine clamp mutation and (ii) a second polypeptide chain comprising a CpmFc(+) domain comprising a cysteine clamp mutation. In some embodiments, the N-terminus of the GDF15 region is linked to the C-terminus of the CpmFc(−) domain comprising a cysteine clamp mutation, directly or via a polypeptide linker. In other embodiments, the N-terminus of the CpmFc(−) domain comprising a cysteine clamp mutation is linked to the C-terminus of the GDF15 region, directly or via a polypeptide linker.

In some embodiments a heterodimer is provided comprises (i) a first polypeptide chain comprising a GDF15 region linked to a DhCpmFc(+) domain comprising a cysteine clamp mutation and (ii) a second polypeptide chain comprising a DhCpmFc(−) domain comprising a cysteine clamp mutation. In some embodiments, the N-terminus of the GDF15 region is linked to the C-terminus of the DhCpmFc(+) domain comprising a cysteine clamp mutation, directly or via a polypeptide linker. In other embodiments, the N-terminus of the DhCpmFc(+) domain comprising a cysteine clamp mutation is linked to the C-terminus of the GDF15 region, directly or via a polypeptide linker.

In some embodiments a heterodimer is provided comprises (i) a first polypeptide chain comprising a GDF15 region linked to a DhCpmFc(−) domain comprising a cysteine clamp mutation and (ii) a second polypeptide chain comprising a DhCpmFc(+) domain comprising a cysteine clamp mutation. In some embodiments, the N-terminus of the GDF15 region is linked to the C-terminus of the DhCpmFc(−) domain comprising a cysteine clamp mutation, directly or via a polypeptide linker. In other embodiments, the N-terminus of the DhCpmFc(−) domain comprising a cysteine clamp mutation is linked to the C-terminus of the GDF15 region, directly or via a polypeptide linker.

Figure 5:
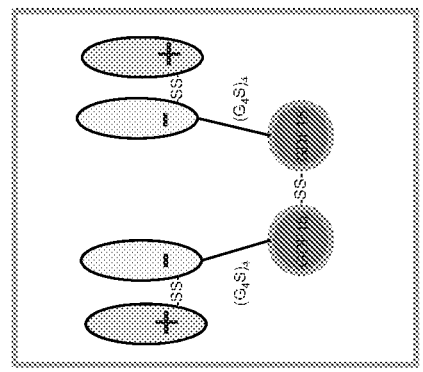
FIG. 5 is a graphic depicting a charged pair (delHinge) cysteine clamp construct comprising a dimer of two DhCpmFc(−)(L351C)-(G₄S)₂-GDF15:DhCpmFc(−)(L351C) heterodimers.

In some embodiments, a tetramer is provided comprising a dimer of two such heterodimers in which the two first polypeptide chains of the heterodimers are linked via an interchain disulfide bond between their respective GDF15 regions. See FIG. 5 for a graphic depiction of an embodiment of a tetramer comprising two heterodimers, where each heterodimer comprises (i) a first polypeptide chain comprising a GDF15 polypeptide linked via a polypeptide linker to a DhCpmFc(+)(L351C) domain and (ii) a second polypeptide chain comprising a DhCpmFc(−)(L351C) domain.

II.F.1 DhCpmFc(+)(S354C)-GDF15(N3D):DhCpmFc(−)(Y349C)

The designation "DhCpmFc(+)(S354C)-GDF15(N3D):DhCpmFc(−)(Y349C)" in the instant disclosure refers to a heterodimer comprising (i) a first polypeptide chain comprising a GDF15(N3D) polypeptide, the N-terminus of which is linked directly to the C-terminus of a DhCpmFc(+)(S354C) domain, and (ii) a second polypeptide chain comprising a DhCpmFc(−)(Y349C) domain. The cysteine clamp mutations allow the first and second polypeptide chains to be linked via an interchain disulfide bond between C354 of the first polypeptide chain and C349 of the second polypeptide chain.

In certain embodiments, a tetramer is provided, comprising a dimer of two DhCpmFc(+)(S354C)-GDF15(N3D):DhCpmFc(−)(Y349C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(S354C) domains (one each heterodimer) comprising the sequence:

```
                                         (SEQ ID NO: 85)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG,
```

(b) two DhCpmFc(−)(Y349C) domains (one each heterodimer) comprising the sequence:

```
                                        (SEQ ID NO: 284)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG,
``` and (c) two GDF15(N3D) polypeptides (one each heterodimer) comprising the sequence of SEQ ID NO:52.

In a preferred embodiment, the first polypeptide chain comprises the amino acid sequence:

```
                                         (SEQ ID NO: 88)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI,
``` which is encoded by the nucleic acid sequence:

```
                                         (SEQ ID NO: 87)
gccccagagctgcttggtggaccatccgtgttcctgtttcctccaaagcc gaaggacaccctgatgatctcaagaactccggaagtgacttgcgtcgtcg tggacgtgtcacatgaggatccagaggtcaagttcaattggtatgtggac ggagtggaagtgcataacgccaagaccaaacccgcgaagaacagtacaa tagcacctaccgcgtggtgagcgtccttactgtgctccaccaggactggc ttaatgggaaggaatacaagtgtaaggtgtccaacaaggccctccccgct cccatcgaaaagaccatctcaaaggcaaaggggcaaccaagggaacctca agtgtacaccctgcctccgtgcaggaaggagatgaccaagaaccaggtca gcctgacttgtctcgtgaagggcttctatcccagcgatattgctgtggaa tgggagtcaaatggccagcccgagaataactacaaaactaccccacccgt gctgaaatctgatgggtccttcttcctttactccaagctgaccgtggaca agagccgctggcaacaaggcaatgtctttagctgctcagtgatgcatgag gctctccataatcactacactcagaagtcactgtccctgtcacctggcgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.
```

In a preferred embodiment, the second polypeptide chain and comprises the amino acid sequence:

```
                                         (SEQ ID NO: 86)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGK,
``` which is encoded by the nucleic acid sequence:

```
                                         (SEQ ID NO: 89)
gcacctgaactcctgggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa
```

-continued

```
cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaagggcagccccgagaaccaca ggtgtgcaccctgcccccatcccggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtaa a.
```

As discussed above, a tetramer is provided comprising two polypeptide chains comprising the sequence of SEQ ID NO:88 and two polypeptide chains comprising the sequence of SEQ ID NO:86.

II.F.2 DhCpmFc(−)(Y349C)-GDF15:DhCpmFc(+)(S354C)

The designation "DhCpmFc(−)(Y349C)-GDF15:DhCpmFc(+)(S354C)" in the instant disclosure refers to a heterodimer comprising (i) a first polypeptide chain comprising a GDF15 polypeptide, the N-terminus of which is linked directly to the C-terminus of a DhCpmFc(−)(Y349C) domain, and (ii) a second polypeptide chain comprising a DhCpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(Y349C)-GDF15:DhCpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(S354C) domains (one each heterodimer) comprising the sequence:

```
                                   (SEQ ID NO: 285)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG,
```

(b) two DhCpmFc(−)(Y349C) domains (one each heterodimer) comprising the sequence:

```
                                   (SEQ ID NO: 91)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG,
``` and (c) two GDF15 polypeptides (one each heterodimer) comprising the sequence of SEQ ID NO:12.

In a preferred embodiment, the first polypeptide chain comprises the amino acid sequence:

```
                                   (SEQ ID NO: 93)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARNGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI,
``` which is encoded by the nucleic acid sequence:

```
                                   (SEQ ID NO: 92)
gcacctgaactcctggggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaagggcagccccgagaaccaca ggtgtgcaccctgcccccatcccggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcaacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.
```

In a preferred embodiment, the second polypeptide chain comprises the sequence:

```
                                   (SEQ ID NO: 90)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTLPPCRKEMTKNQVSLTCLVKGFYPSDIAVE
```

-continued

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 94)
gccccagagctgcttggtggaccatccgtgttcctgtttcctccaaagcc gaaggacaccctgatgatctcaagaactccggaagtgacttgcgtcgtcg tggacgtgtcacatgaggatccagaggtcaagttcaattggtatgtggac ggagtggaagtgcataacgccaagaccaaacccgcgaagaacagtacaa tagcacctaccgcgtggtgagcgtccttactgtgctccaccaggactggc ttaatgggaaggaatacaagtgtaaggtgtccaacaaggccctcccgct cccatcgaaaagaccatctcaaaggcaaagggcaaccaagggaacctca agtgtacaccctgcctccgtgcaggaaggagatgaccaagaaccaggtca gcctgacttgtctcgtgaagggcttctatcccagcgatattgctgtggaa tgggagtcaaatggccagcccgagaataactacaaaactacccacccgt gctgaaatctgatgggtccttcttcctttactccaagctgaccgtggaca agagccgctggcaacaaggcaatgtctttagctgctcagtgatgcatgag gctctccataatcactacactcagaagtcactgtccctgtctccgggtaa a.

As discussed above, a tetramer is provided comprising two polypeptide chains comprising the sequence of SEQ ID NO:93 and two polypeptide chains comprising the sequence of SEQ ID NO:90.

II.F.3 DhCpmFc(−)(Y349C)-GDF15(N3D):DhCpmFc(+)(S354C)

The designation "DhCpmFc(−)(Y349C)-GDF15(N3D):DhCpmFc(+)(S354C)" in the instant disclosure refers to heterodimer comprising (i) a first polypeptide chain comprising a GDF15(N3D) polypeptide, the N-terminus of which is linked directly to the C-terminus of a DhCpmFc(−)(Y349C) domain and (ii) a second polypeptide chain comprising a DhCpmFc(+)(S345C) domain. The cysteine clamp mutations allow the first and second polypeptide chains to be linked via an interchain disulfide bond between C349 of the first polypeptide and C354 of the second polypeptide.

In certain embodiments, a tetramer is provided, comprising a dimer of two DhCpmFc(−)(Y349C)-GDF15(N3D):DhCpmFc(+)(S354C) heterodimers in which the two first polypeptide chains of each heterodimer are linked via an interchain disulfide bond between their respective GDF15 regions. An N3D mutation in GDF15 sequence may be introduced, e.g., to eliminate heterogeneity caused by N deamidation.

More particularly, in a specific embodiment, the tetramer comprises:
 (a) two DhCpmFc(+)(S354C) domains (one each heterodimer) comprising the sequence of SEQ ID NO:285,
 (b) two DhCpmFc(−)(Y349C) domains (one each heterodimer) comprising the sequence of SEQ ID NO:91, and
 (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 96)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 95)
gcacctgaactcctgggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.

In a preferred embodiment, the second polypeptide chain comprises the amino acid sequence of SEQ ID NO:90, which is encoded by the nucleic acid sequence of SEQ ID NO:94.

As discussed above, a tetramer is provided comprising two polypeptide chains comprising the sequence of SEQ ID NO:96 and two polypeptide chains comprising the sequence of SEQ ID NO:90.

II.F.4 DhCpmFc(−)(Y349C)-GDF15(Ndel3):DhCpmFc(+)(S354C)

The designation "DhCpmFc(−)(Y349C)-GDF15(Ndel3):DhCpmFc(+)(S354C)" in the instant disclosure refers to a heterodimer comprising (i) a first polypeptide chain comprising a GDF15(Ndel3) polypeptide, the N-terminus of which is linked directly to the C-terminus of a DhCpmFc(−)(Y349C) domain, and (ii) a second polypeptide chain comprising a DhCpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(Y349C)-GDF15(Ndel3): DhCpmFc(+)(S354C) heterodimers in which the two first polypeptide chains of each heterodimer are linked via an interchain disulfide bond between their respective GDF15 regions. Deletion of the N-terminal 3 amino acids (Ndel3) in GDF15 sequence may be introduced, e.g., to eliminate heterogeneity caused by deamidation of asparagines or isomerization of aspartic acid.

More particularly, in a specific embodiment, the tetramer comprises:
(a) two DhCpmFc(+)(S354C) domains (one each heterodimer) of comprising the sequence of SEQ ID NO:285,
(b) two DhCpmFc(−)(Y349C) domains (one each heterodimer) comprising the sequence of SEQ ID NO:91, and
(c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 98)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGDHCPLGPGRCCRLHTVRASLEDLGWADWVLSPR

EVQVTMCIGACPSQFRAANMHAQIKTSLHRLKPDTVPAPCCVPASYNPMV

LIQKTDTGVSLQTYDDLLAKDCHCI, which is encoded by the nucleic acid sequence:

(SEQ ID NO: 97)
gcacctgaactcctggggggaccgtcagtcttcctcttcccccaaaacc caaggacaccctcatgatctcccggacccctgaggtcacatgcgtggtg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggccgggcgttgctgccgtctgcacacggtcc gcgcgtcgctggaagacctgggctgggccgattgggtgctgtcgccacgg gaggtgcaagtgaccatgtgcatcggcgcgtgcccgagccagttccggc ggcaaacatgcacgcgcagatcaagacgagcctgcaccgcctgaagcccg acacggtgccagcgccctgctgcgtgcccgccagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence of SEQ ID NO:90, which is encoded by the nucleic acid sequence of SEQ ID NO:94.

As discussed above, a tetramer is provided comprising two polypeptide chains comprising the sequence of SEQ ID NO:98 and two polypeptide chains comprising the sequence of SEQ ID NO:90.

II.F.5 DhCpmFc(−)(Y349C)-G$_4$-GDF15(N3D):DhCpmFc(+)(S354C)

The designation "DhCpmFc(−)(Y349C)-G$_4$-GDF15(N3D):DhCpmFc(+)(S354C)" in the instant disclosure refers to a heterodimer comprising (i) a first polypeptide chain comprising a GDF15(N3D) polypeptide linked to a DhCpmFc(−)(Y349C) domain via a linker comprising the sequence of SEQ ID NO:58 that connects the N-terminus of the GDF15(N3D) polypeptide to the C-terminus of a DhCpmFc(−)(Y349C) domain and (ii) a second polypeptide chain comprising a DhCpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(Y349C)-G$_4$-GDF15(N3D):DhCpmFc(+)(S354C) heterodimers in which the two first polypeptide chains of each heterodimer are linked via an interchain disulfide bond between their respective GDF15 regions.

More particularly, in a specific embodiment, the tetramer comprises:
(a) two DhCpmFc(+)(S354C) domains (one each heterodimer) of comprising the sequence of SEQ ID NO:285,
(b) two DhCpmFc(−)(Y349C) domains (one each heterodimer) comprising the sequence of SEQ ID NO:91,
(c) two GDF15(N3D) polypeptides (one each heterodimer) comprising the sequence of SEQ ID NO:52, and
(d) two polypeptide linkers (one each heterodimer) comprising the sequence of SEQ ID NO:58 each linking the N-terminus of a GDF15(N3D) polypeptide to the C-terminus of a DhCpmFc(−)(Y349C) domain via a peptide bond.

In a preferred embodiment, the first polypeptide chain comprises the amino acid sequence (linker sequence double underlined):

(SEQ ID NO: 100)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGG</u>ARDGDHCPLGPGRCCRLHTVRASLEDLGWA

DWVLSPREVQVTMCIGACPSQFRAANMHAQIKTSLHRLKPDTVPAPCCVP

ASYNPMVLIQKTDTGVSLQTYDDLLAKDCHCI, which is encoded by the nucleic acid sequence:

(SEQ ID NO: 99)
gcacctgaactcctgggggaccgtcagtcttcctcttcccccaaaacc caaggacaccctcatgatctcccgga ccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg tggaggtggtgcgcgcgacggagaccactgtccgctcgggcccgggcgtt gctgccgtctgcacacggtccgcgcgtcgctggaagacctgggctgggcc gattgggtgctgtcgccacgggaggtgcaagtgaccatgtgcatcggcgc gtgcccgagccagttccgggcggcaaacatgcacgcgcagatcaagacga gcctgcaccgcctgaagcccgacacggtgccagcgccctgctgcgtgccc gccagctacaatcccatggtgctcattcaaaagaccgacaccggggtgtc gctccagacctatgatgacttgttagccaaagactgccactgcata.

In a preferred embodiment, the second polypeptide chain comprises the amino acid sequence of SEQ ID NO:90, which is encoded by the nucleic acid sequence of SEQ ID NO:94.

As discussed above, in a specific embodiment, a heterotetramer is provided comprising two monomers having the sequence of SEQ ID NO:100 and two monomers having the sequence of SEQ ID NO:90.

II.F.6 DhCpmFc(−)(Y349C)-(G$_4$S)$_2$-GDF15(N3D):DhCpmFc(+)(S354C)

The designation "DhCpmFc(−)(Y349C)-(G$_4$S)$_2$-GDF15(N3D):DhCpmFc(+)(S354C)" in the instant disclosure refers to a heterodimer comprising (i) a first polypeptide chain comprising a GDF15(N3D) polypeptide linked to a DhCpmFc(−)(Y349C) domain via a linker comprising the sequence of SEQ ID NO:64 that connects the N-terminus of the GDF15(N3D) polypeptide to the C-terminus of a DhCpmFc(−)(Y349C) domain, and (ii) a second polypeptide chain comprising a DhCpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(Y349C)-(G$_4$S)$_2$-GDF15(N3D):DhCpmFc(+)(S354C) heterodimers in which the two first polypeptide chains of each heterodimer are linked via an interchain disulfide bond between their respective GDF15 regions.

More particularly, in a specific embodiment, the tetramer:

(a) two DhCpmFc(+)(S354C) domains (one each heterodimer) of comprising the sequence of SEQ ID NO:285, (b) two DhCpmFc(−)(Y349C) domains (one each heterodimer) comprising the sequence of SEQ ID NO:91, (c) two GDF15(N3D) polypeptides (one each heterodimer) comprising the sequence of SEQ ID NO:52, and (d) two polypeptide linkers (one each heterodimer) comprising the sequence of SEQ ID NO:64 each linking the N-terminus of a GDF15(N3D) polypeptide to the C-terminus of a DhCpmFc(−)(Y349C) domain via a peptide bond.

In a preferred embodiment, the first polypeptide comprises the amino acid sequence (linker sequence double underlined):

(SEQ ID NO: 102)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGSGGGGS</u>ARDGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI, which is encoded by the nucleic acid sequence:

(SEQ ID NO: 101)
gcacctgaactcctgggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggatccggaggcggtggaagcgcgcgcgacggagaccactgtc cgctcgggcccgggcgttgctgccgtctgcacacggtccgcgcgtcgctg gaagacctgggctgggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcata.

In a preferred embodiment, the second polypeptide chain comprises the amino acid sequence of SEQ ID NO:90, which is encoded by the nucleic acid sequence of SEQ ID NO:94.

As discussed above, in a specific embodiment, a heterotetramer is provided comprising two monomers having the sequence of SEQ ID NO:102 and two monomers having the sequence of SEQ ID NO:90.

II.F.7 DhCpmFc(-)(Y349C)-(G$_4$Q)$_2$-GDF15(N3D):DhCpmFc(+)(S354C)

The designation "DhCpmFc(-)(Y349C)-(G$_4$Q)$_2$-GDF15(N3D):DhCpmFc(+)(S354C)" in the instant disclosure refers to a heterodimer comprising (i) a first polypeptide chain comprising a GDF15(N3D) polypeptide linked to a DhCpmFc(-)(Y349C) domain via a linker comprising the sequence of SEQ ID NO:78 that connects the N-terminus of the GDF15(N3D) polypeptide to the C-terminus of the DhCpmFc(-)(Y349C) domain, and (ii) a second polypeptide chain comprising a DhCpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(-)(Y349C)-(G$_4$Q)$_2$-GDF15(N3D):DhCpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(S354C) domains (one each heterodimer) of comprising the sequence of SEQ ID NO:285, (b) two DhCpmFc(-)(Y349C) domains (one each heterodimer) comprising the sequence of SEQ ID NO:91, (c) two GDF15(N3D) polypeptides (one each heterodimer) comprising the sequence of SEQ ID NO:52, and (d) two polypeptide linkers (one each heterodimer) comprising the sequence of SEQ ID NO:78 each linking the N-terminus of a GDF15(N3D) polypeptide to the C-terminus of a DhCpmFc(-)(Y349C) domain via a peptide bond.

In a preferred embodiment, the first polypeptide comprises the amino acid sequence (linker sequence double underlined):

```
                                              (SEQ ID NO: 104)
APELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGGGGQGGGGQARDGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI,
``` which is encoded by the nucleic acid sequence:

```
                                              (SEQ ID NO: 103)
gcacctgaactcctgggggaccgtcagtcttcctcttccccccaaaacc caaggacaccctcatgatctcccggaccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcagggaacgtcttctcatgctccgtgatgcatgag gctctgcacaaccactacacgcagaagagcctctccctgtctccgggtgg aggtggtggacagggaggcggtggacaggcgcgcgacggagaccactgtc cgctcgggcccgggcgttgctgccgtctgcacacggtccgcgcgtcgctg gaagacctgggctgggccgattgggtgctgtcgccacgggaggtgcaagt gaccatgtgcatcggcgcgtgcccgagccagttccgggcggcaaacatgc acgcgcagatcaagacgagcctgcaccgcctgaagcccgacacggtgcca gcgccctgctgcgtgcccgccagctacaatcccatggtgctcattcaaaa gaccgacaccggggtgtcgctccagacctatgatgacttgttagccaaag actgccactgcata.
```

In a preferred embodiment, the second polypeptide chain comprises the amino acid sequence of SEQ ID NO:90, which is encoded by the nucleic acid sequence of SEQ ID NO:94.

As discussed above, in a specific embodiment, a heterotetramer is provided comprising two monomers having the sequence of SEQ ID NO:104 and two monomers having the sequence of SEQ ID NO:90.

II.F.8. DhCpmFc(-)(L351C)-(G$_4$S)$_2$-GDF15:DhCpmFc(+)(L351C)

The designation "DhCpmFc(-)(L351C)-(G$_4$S)$_2$-GDF15:DhCpmFc(+)(L351C)" in the instant disclosure refers to a heterodimer comprising (i) a first polypeptide chain comprising a GDF15 polypeptide linked to a DhCpmFc(-)(L351C) domain via a linker comprising the sequence of SEQ ID NO:64 that connects the N-terminus of the GDF15 polypeptide to the C-terminus of the DhCpmFc(-)(L351C) domain, and (ii) a second polypeptide chain comprising a DhCpmFc(+)(L351C) domain. The cysteine clamp mutations allow the first and second polypeptide chains to be linked via an interchain disulfide bond between C351 of the first polypeptide chain and C351 of the second polypeptide chain.

In certain embodiments, a tetramer is provided, comprising a dimer of two DhCpmFc(-)(L351C)-(G$_4$S)$_2$-GDF15:DhCpmFc(+)(L 351C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(L351C) domains (one each heterodimer) comprising the sequence:

(SEQ ID NO: 286)
APELLGGPSVFLFPPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTCPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG, (b) two DhCpmFc(–)(L351C) domains (one each heterodimer) comprising the sequence:

(SEQ ID NO: 106)
APELLGGPSVFLFPPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTCPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG, (c) two GDF15 polypeptide chains (one each heterodimer) comprising the sequence of SEQ ID NO:12, and (d) two polypeptide linkers (one each heterodimer) comprising the sequence of SEQ ID NO:64 each linking the N-terminus of a GDF15 polypeptide to the C-terminus of a DhCpmFc(–)(L351C) domain via a peptide bond.

In a preferred embodiment, the first polypeptide chain comprises the amino acid sequence (linker sequence double underlined):

(SEQ ID NO: 108)
APELLGGPSVFLFPPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTCPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGGSGGGGS</u>ARNGDHCPLGPGRCCRLHTVRASL

EDLGWADWVLSPREVQVTMCIGACPSQFRAANMHAQIKTSLHRLKPDTVP

APCCVPASYNPMVLIQKTDTGVSLQTYDDLLAKDCHCI, which is encoded by the nucleic acid sequence:

(SEQ ID NO: 107)
gcgccggaactgctgggcggcccgagcgtgtttctgtttccgccgaaacc gaaagatacccctgatgattagccgcaccccggaagtgacctgcgtggtgg tggatgtgagccatgaagatccggaagtgaaatttaactggtatgtggat ggcgtggaagtgcataacgcgaaaaccaaaccgcgcgaagaacagtataa cagcacctatcgcgtggtgagcgtgctgaccgtgctgcatcaggattggc tgaacggcaaagaatatataaatgcaaagtgagcaacaaagcgctgccggcg ccgattgaaaaaaccattagcaaagcgaaaggccagccgcgcgaaccgca ggtgtatacctgcccgccgagccgcgaagaaatgaccaaaaaccaggtga gcctgacctgcctggtgaaaggcttttatccgagcgatattgcggtggaa tgggaaagcaacggccagccgaaaacaactatgataccaccccgccggt gctggatagcgatggcagcttttttctgtatagcgatctgaccgtggata aaagccgctggcagcagggcaacgtgtttagctgcagcgtgatgcatgaa gcgctgcataaccattatacccagaaaagcctgagcctgagcccggcgg cggcggcggcagcggcggcggcggcagcgcgcgcaacggcgatcattgcc cgctgggcccgggccgctgctgccgcctgcataccgtgcgcgcgagcctg gaagatctgggctgggcggattgggtgctgagcccgcgcgaagtgcaggt gaccatgtgcattggcgcgtgcccgagccagtttcgcgcggcgaacatgc atgcgcagattaaaaccagcctgcatcgcctgaaaccggataccgtgccg gcgccgtgctgcgtgccggcgagctataacccgatggtgctgattcagaa aaccgataccggcgtgagcctgcagacctatgatgatctgctggcgaaag attgccattgcatt.

In a preferred embodiment, the second polypeptide chain and comprises the amino acid sequence:

(SEQ ID NO: 105)
APELLGGPSVFLFPPPKPKDTLMISRTPEVTCVVVDVSHEDPEVKFNWYVD

GVEVHNAKTKPREEQYNSTYRVVSVLTVLHQDWLNGKEYKCKVSNKALPA

PIEKTISKAKGQPREPQVYTCPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 109)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacaa cagcacgtaccgtgtggtcagcgtcctcaccgtcctgcaccaggactggc tgaatggcaaggagtacaagtgcaaggtctccaacaaagcccctcccagcc cccatcgagaaaaccatctccaaagccaaagggcagccccgagaaccaca ggtgtacaccctgtcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtaa a.

As discussed above, in a specific embodiment, a heterotetramer is provided comprising two monomers having the sequence of SEQ ID NO:108 and two monomers having the sequence of SEQ ID NO:105.

II.G. HSA

The designations "HSA" or "human serum albumin" in the instant disclosure refer to a fusion protein comprising a GDF15 region linked, directly or via a polypeptide linker, to a human serum albumin (HSA) polypeptide. In some embodiments, the fusion protein comprises two or more HSA polypeptides.

Typically, the N-terminus of the GDF15 region is linked, directly or via a polypeptide linker, to the C-terminus of the HSA polypeptide. However, in some embodiments, the N-terminus of the HSA polypeptide is linked, directly or via a polypeptide linker, to the C-terminus of the GDF15 region.

Figure 6:
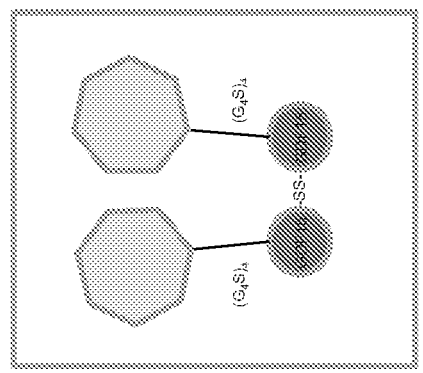
FIG. 6 is a graphic depicting an HSA construct comprising a dimer of two HSA-(G₄S)₄-GDF15 fusion proteins.
Figure 7:
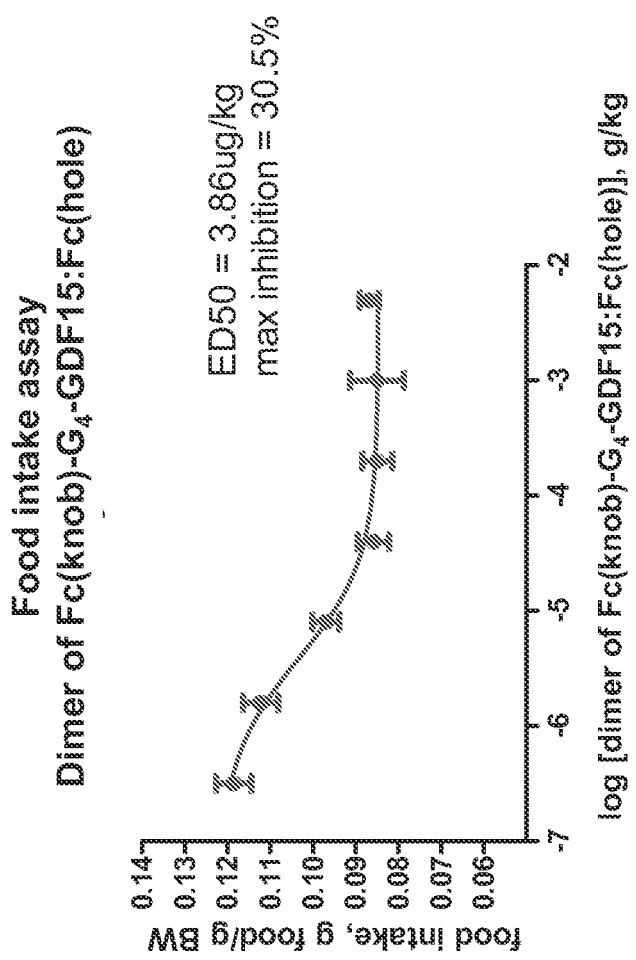
FIG. 7 is a plot showing the effect on food intake (g food/g body weight (BW) of ob/ob mice as a function of dose (log [g construct/kg BW]) using a dimer of the DhknobFc-G₄-GDF15:DhholeFc heterodimer.
Figure 8:
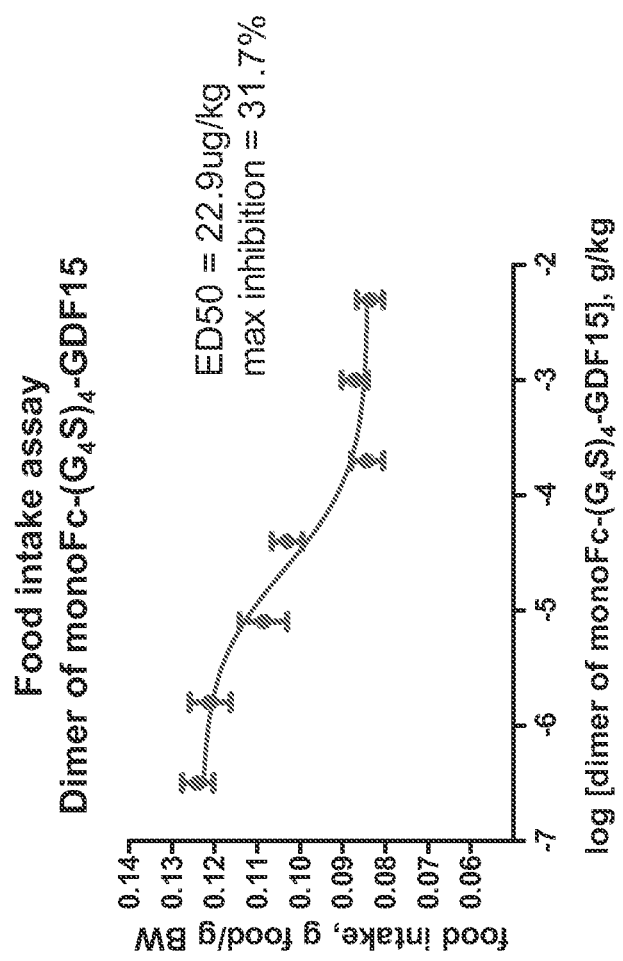
FIG. 8 is a plot showing the effect on food intake (g food/g body weight) of ob/ob mice as a function of dose (log [g construct/kg BW]) using a dimer of the Fc-(G₄S)₄-GDF15 fusion protein.
Figure 9:
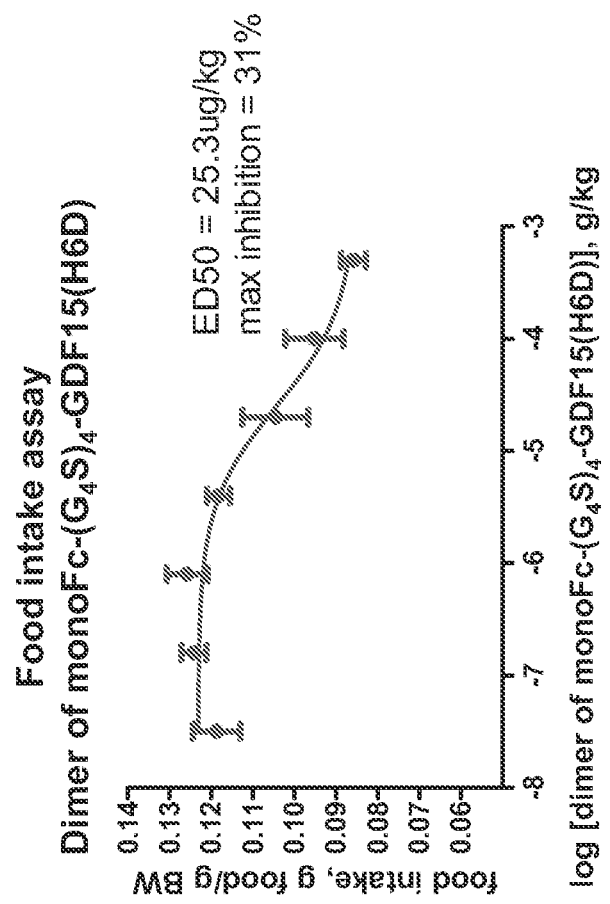
FIG. 9 is a plot showing the effect on food intake (g food/g body weight) of ob/ob mice as a function of dose (log [g construct/kg BW]) using a dimer of the Fc-(G₄S)₄-GDF15 (H6D) fusion protein.
Figure 10:
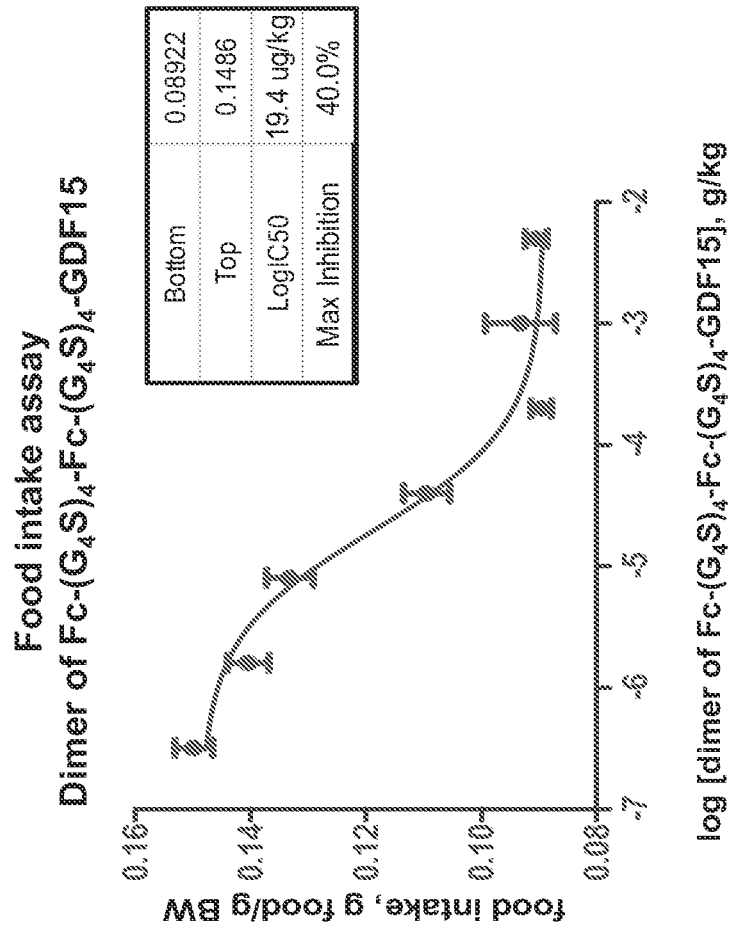
FIG. 10 is a plot showing the effect on food intake (g food/g body weight) of ob/ob mice as a function of dose (log [g construct/kg BW]) using a dimer of the Fc-(G₄S)₄-Fc-(G₄S)₄-GDF15 fusion protein.
Figure 11:
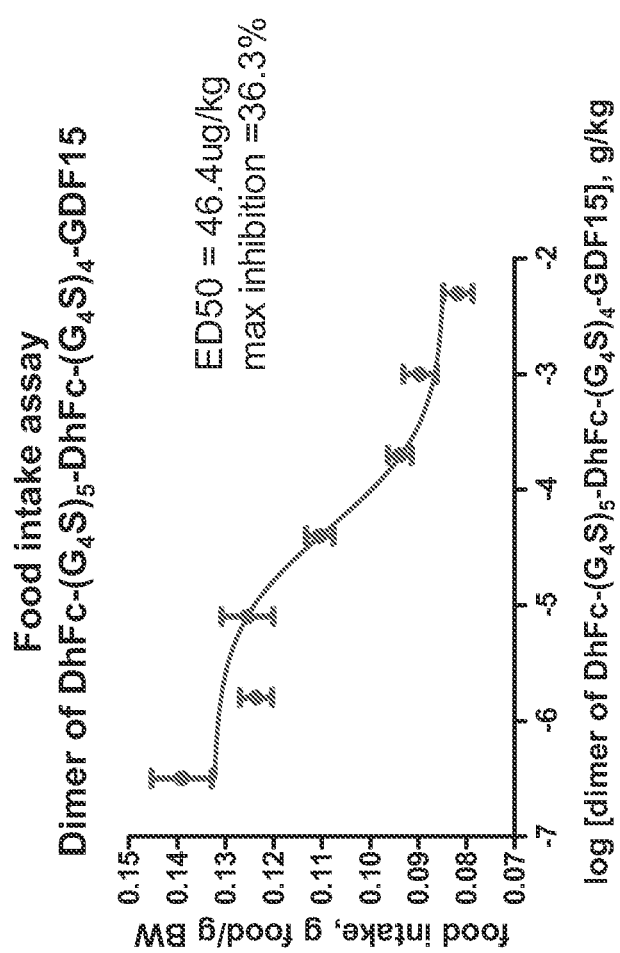
FIG. 11 is a plot showing the effect on food intake (g food/g body weight) of ob/ob mice as a function of dose (log [g construct/kg BW]) using a dimer of the DhFc-(G₄S)₅-DhFc-(G₄S)₄-GDF15 fusion protein.
Figure 12:
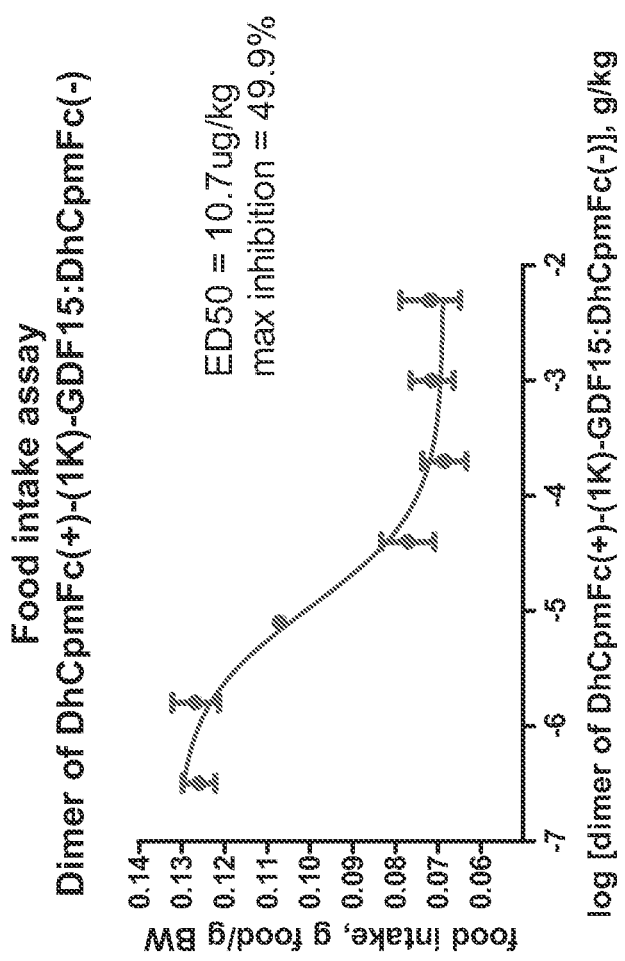
FIG. 12 is a plot showing the effect on food intake (g food/g body weight) of ob/ob mice as a function of dose (log [g construct/kg BW]) using a dimer of the DhCpmFc(+)-(1K)-GDF15:DhCpmFc(−) heterodimer.
Figure 13:
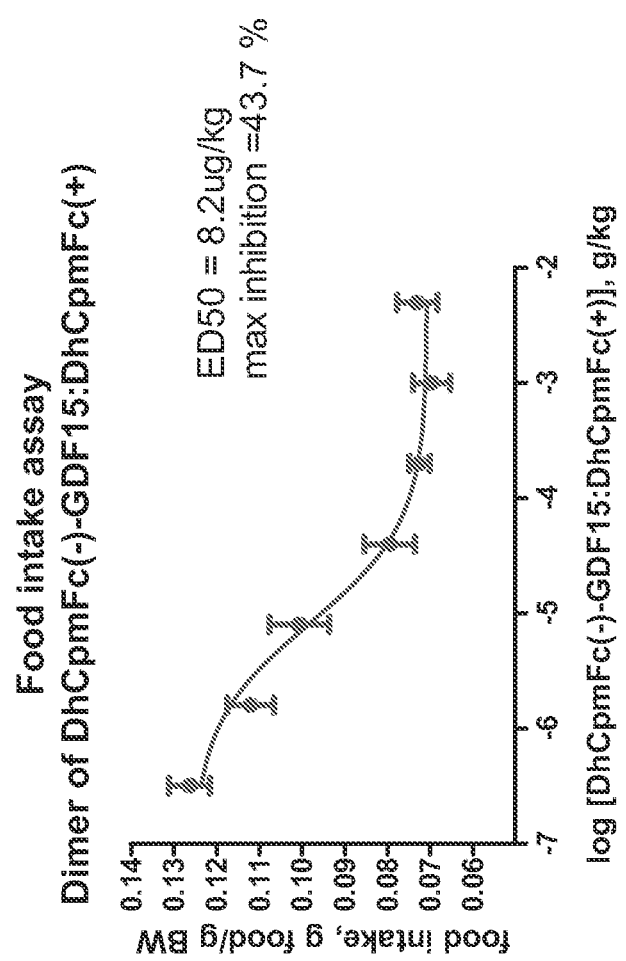
FIG. 13 is a plot showing the effect on food intake (g food/g body weight) of ob/ob mice as a function of dose (log [g construct/kg BW]) using a dimer of the DhCpmFc(−)-GDF15:DhCpmFc(+) heterodimer.
Figure 14:
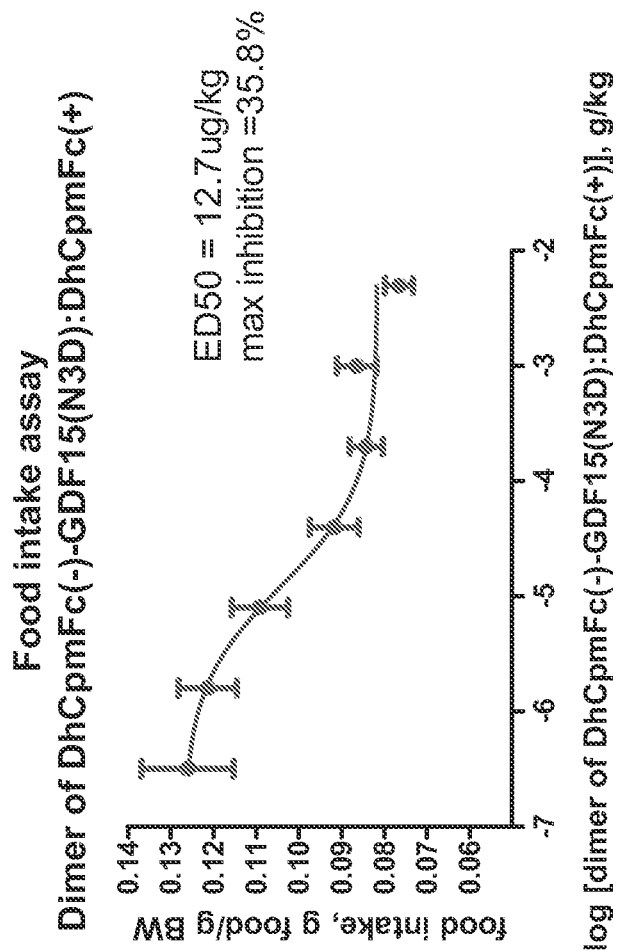
FIG. 14 is a plot showing the effect on food intake (g food/g body weight) of ob/ob mice as a function of dose (log [g construct/kg BW]) using a dimer of the DhCpmFc(−)-GDF15(N3D):DhCpmFc(+) heterodimer.
Figure 15:
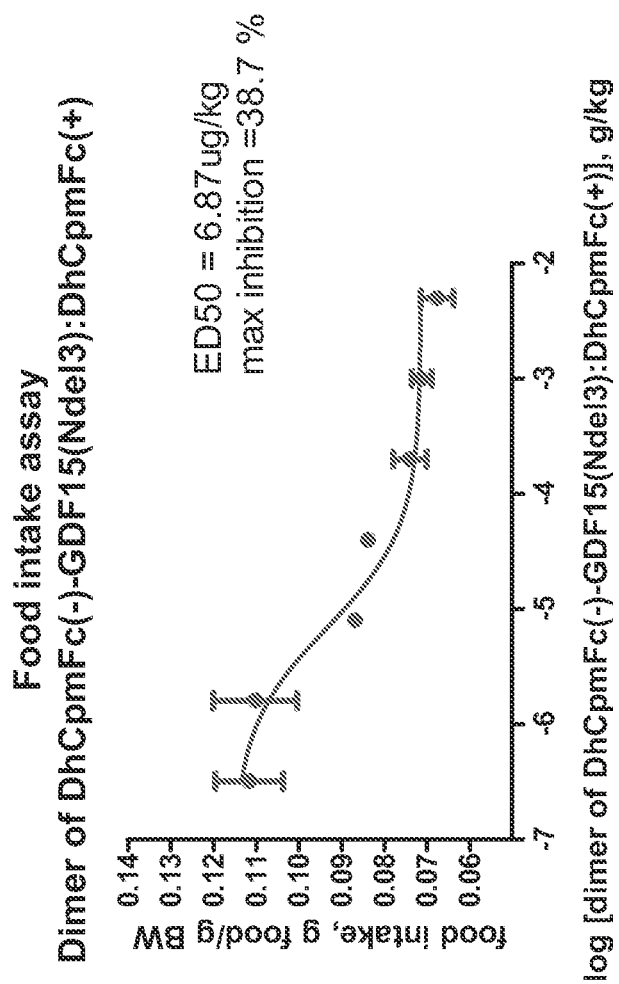
FIG. 15 is a plot showing the effect on food intake (g food/g body weight) of ob/ob mice as a function of dose (log [g construct/kg BW]) using a dimer of the DhCpmFc(−)-GDF15(Ndel3):DhCpmFc(+) heterodimer.
Figure 16:
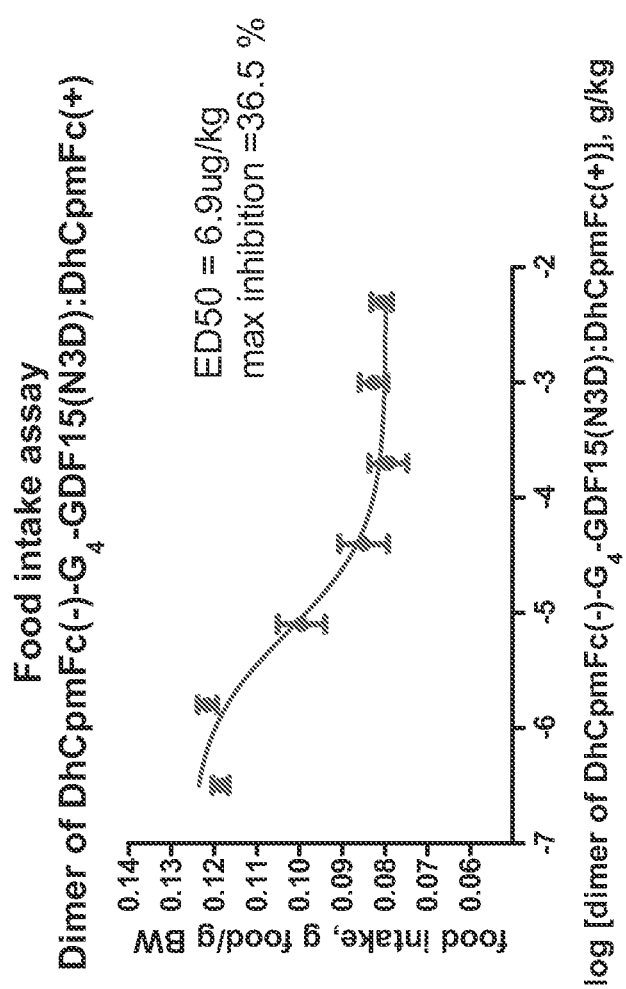
FIG. 16 is a plot showing the effect on food intake (g food/g body weight) of ob/ob mice as a function of dose (log [g construct/kg BW]) using a dimer of the DhCpmFc(−)-G₄-GDF15(N3D):DhCpmFc(+) heterodimer.
Figure 17:
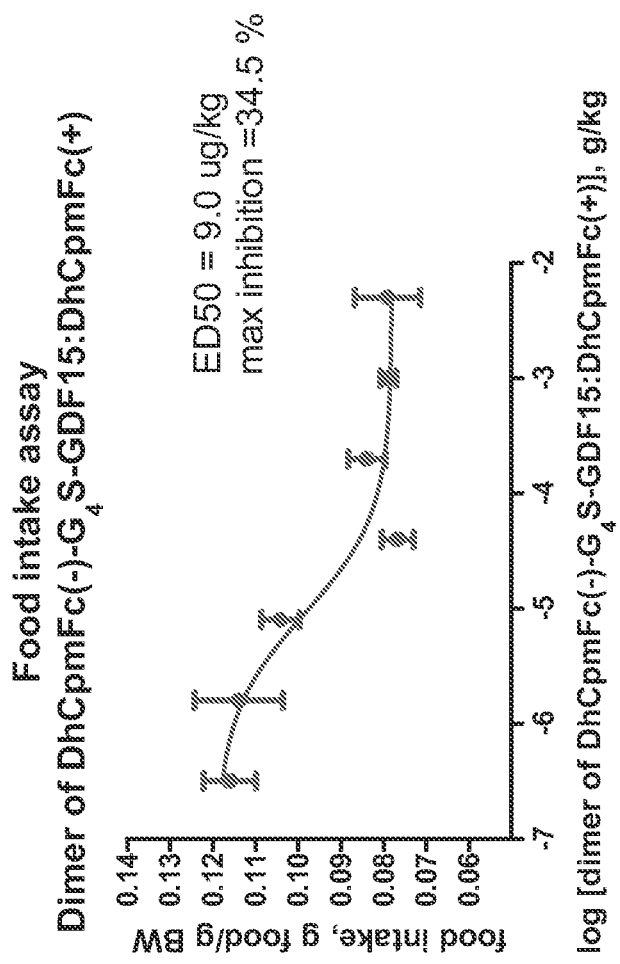
FIG. 17 is a plot showing the effect on food intake (g food/g body weight) of ob/ob mice as a function of dose (log [g construct/kg BW]) using a dimer of the DhCpmFc(−)-G$_4$S-GDF15:DhCpmFc(+) heterodimer.
Figure 18:
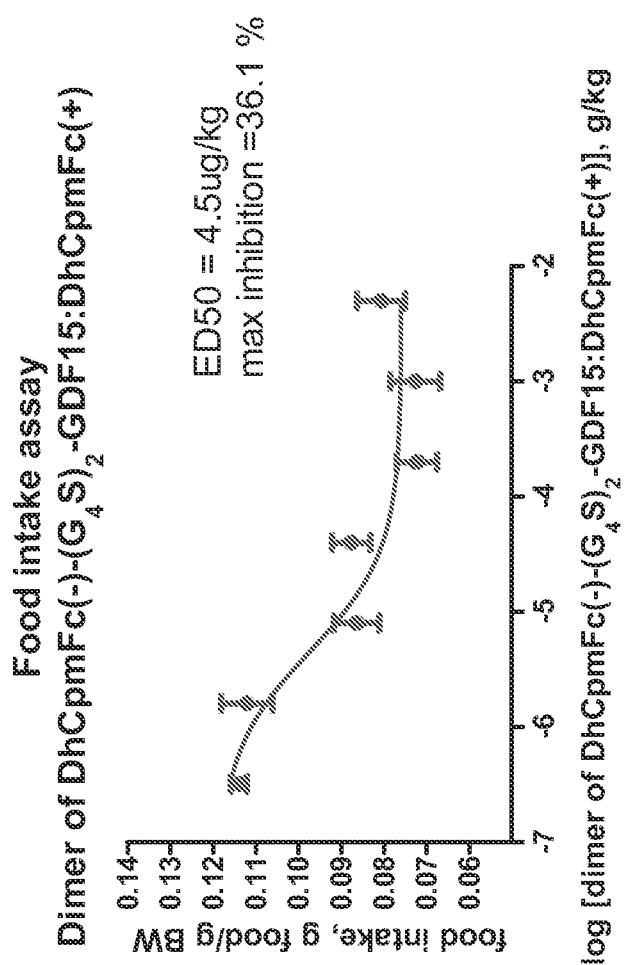
FIG. 18 is a plot showing the effect on food intake (g food/g body weight) of ob/ob mice as a function of dose (log [g construct/kg BW]) using a dimer of the DhCpmFc(−)-(G$_4$S)$_2$-GDF15:DhCpmFc(+) heterodimer.
Figure 19:
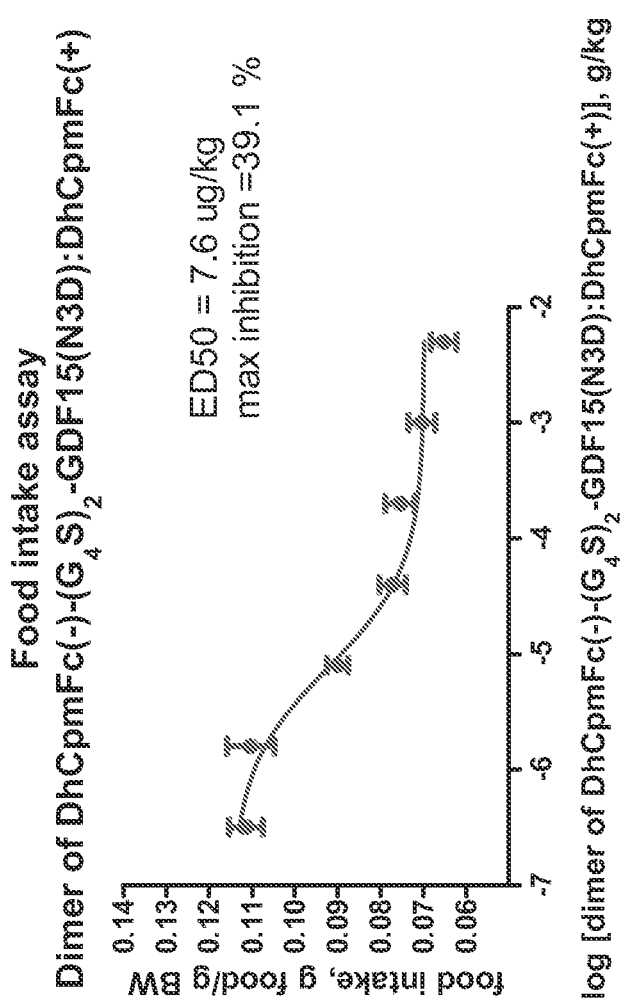
FIG. 19 is a plot showing the effect on food intake (g food/g body weight) of ob/ob mice as a function of dose (log [g construct/kg BW]) using a dimer of the DhCpmFc(−)-(G$_4$S)$_2$-GDF15(N3D):DhCpmFc(+) heterodimer.
Figure 20:
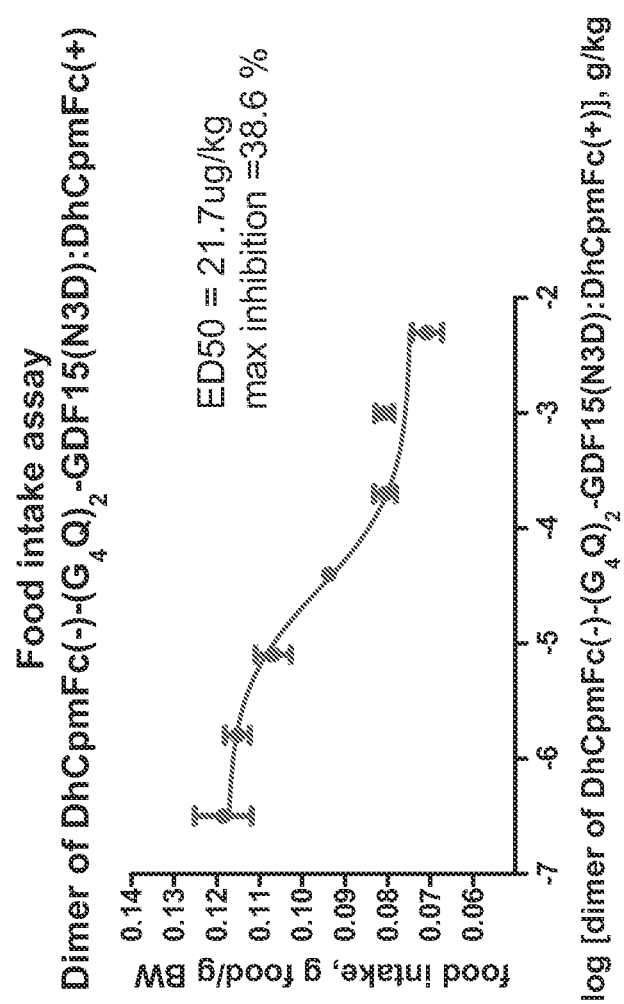
FIG. 20 is a plot showing the effect on food intake (g food/g body weight) of ob/ob mice as a function of dose (log [g construct/kg BW]) using a dimer of the DhCpmFc(−)-(G$_4$Q)$_2$-GDF15(N3D):DhCpmFc(+) heterodimer.
Figure 21:
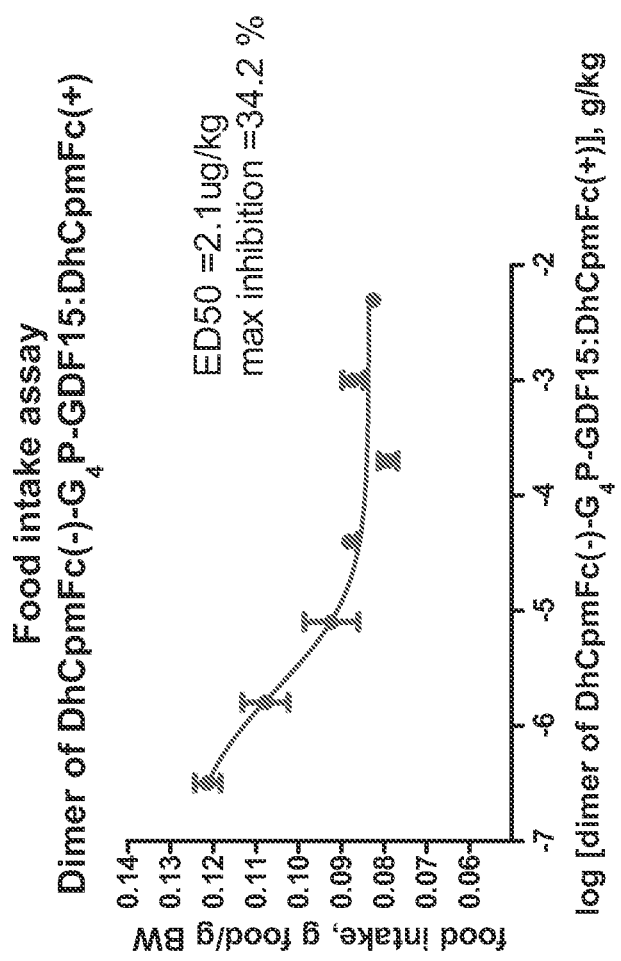
FIG. 21 is a plot showing the effect on food intake (g food/g body weight) of ob/ob mice as a function of dose (log [g construct/kg BW]) using a dimer of the DhCpmFc(−)-G$_4$P-GDF15:DhCpmFc(+) heterodimer.
Figure 22:
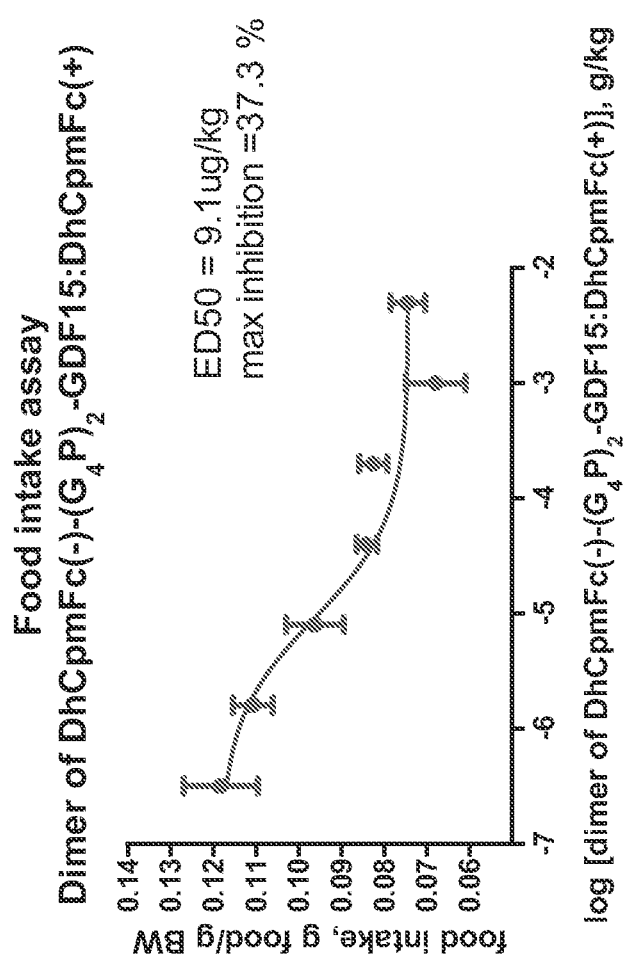
FIG. 22 is a plot showing the effect on food intake (g food/g body weight) of ob/ob mice as a function of dose (log [g construct/kg BW]) using a dimer of the DhCpmFc(−)-(G$_4$P)$_2$-GDF15:DhCpmFc(+) heterodimer.
Figure 23:
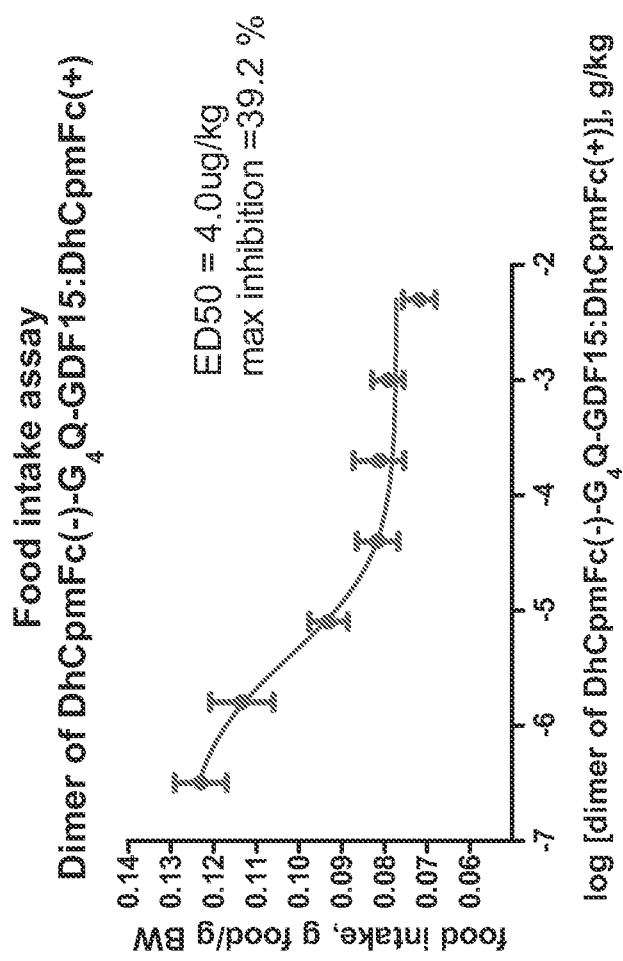
FIG. 23 is a plot showing the effect on food intake (g food/g body weight) of ob/ob mice as a function of dose (log [g construct/kg BW]) using a dimer of the DhCpmFc(−)-G$_4$Q-GDF15:DhCpmFc(+) heterodimer.
Figure 24:
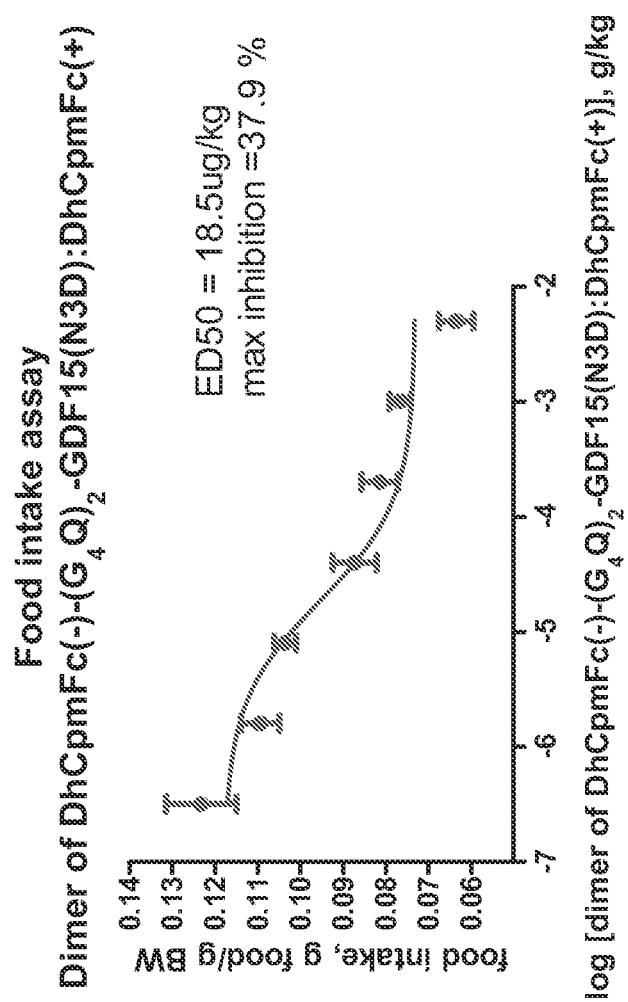
FIG. 24 is a plot showing the effect on food intake (g food/g body weight) of ob/ob mice as a function of dose (log [g construct/kg BW]) using a dimer of the DhCpmFc(−)-(G$_4$Q)$_2$-GDF15(N3D):DhCpmFc(+) heterodimer.
Figure 25:
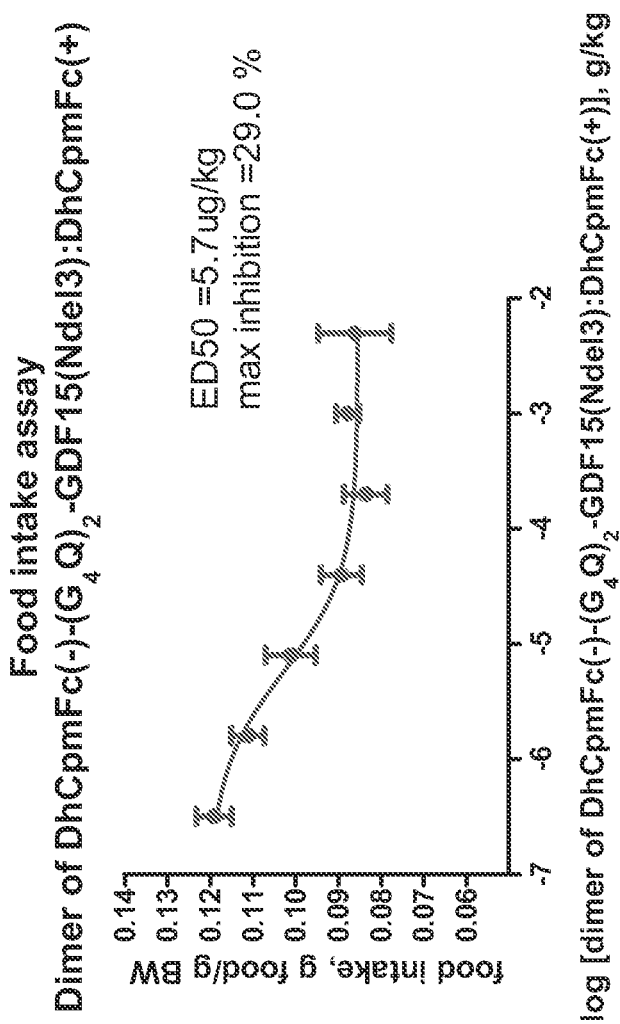
FIG. 25 is a plot showing the effect on food intake (g food/g body weight) of ob/ob mice as a function of dose (log [g construct/kg BW]) using a dimer of the DhCpmFc(−)-(G$_4$Q)$_2$-GDF15(Ndel3):DhCpmFc(+) heterodimer.
Figure 26:
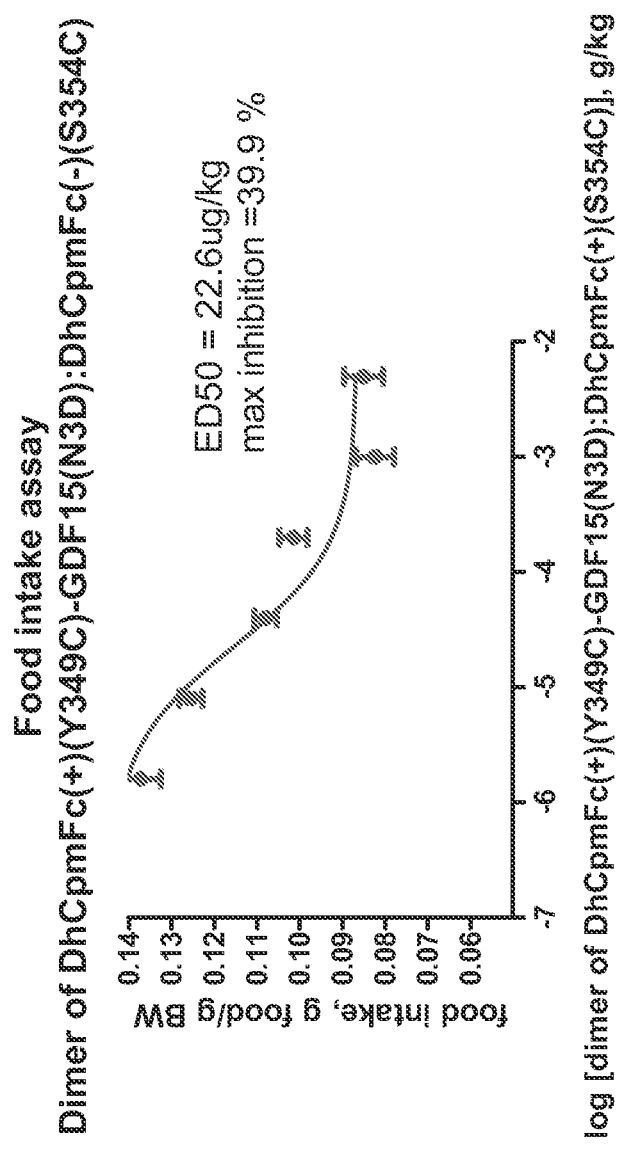
FIG. 26 is a plot showing the effect on food intake (g food/g body weight) of ob/ob mice as a function of dose (log [g construct/kg BW]) using a dimer of the DhCpmFc(+)(Y349C)-GDF15(N3D):DhCpmFc(−)(S354C) heterodimer.
Figure 27:
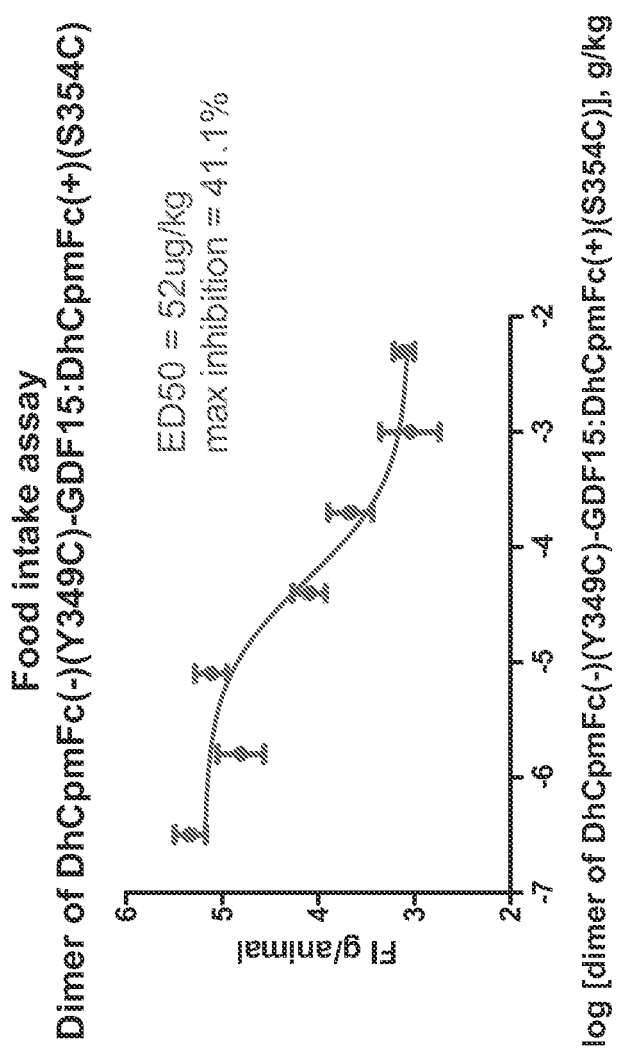
FIG. 27 is a plot showing the effect on food intake (g food/g body weight) of ob/ob mice as a function of dose (log [g construct/kg BW]) using a dimer of the DhCpmFc(−)(Y349C)-GDF15:DhCpmFc(+)(S354C) heterodimer.
Figure 28:
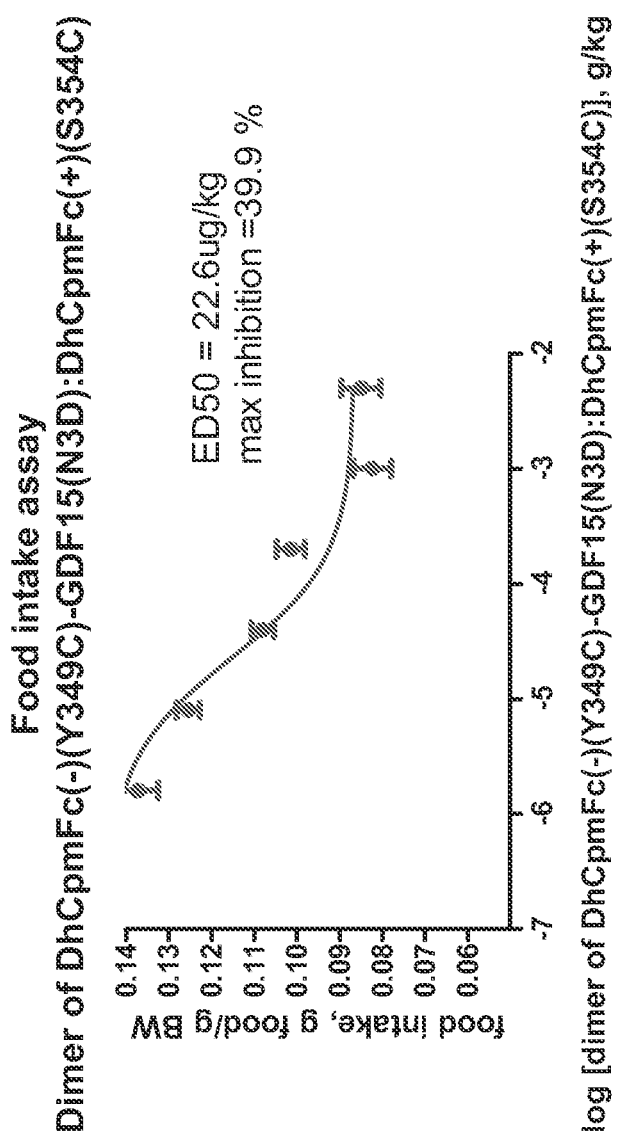
FIG. 28 is a plot showing the effect on food intake (g food/g body weight) of ob/ob mice as a function of dose (log [g construct/kg BW]) using a dimer of the DhCpmFc(−)(Y349C)-GDF15(N3D):DhCpmFc(+)(S354C) heterodimer.
Figure 29:
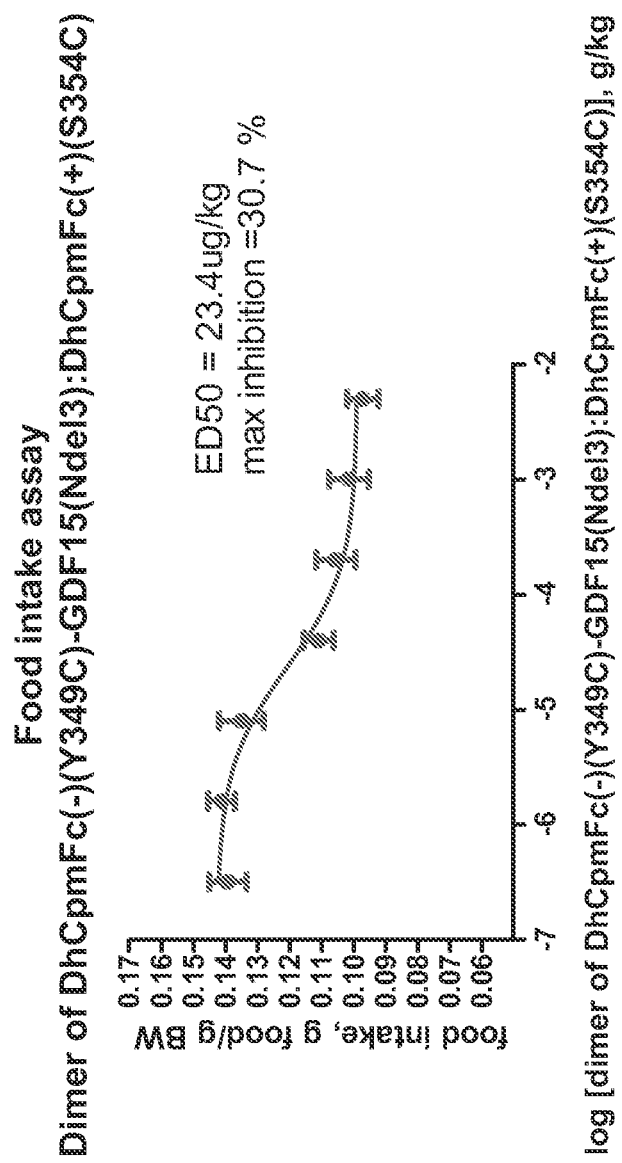
FIG. 29 is a plot showing the effect on food intake (g food/g body weight) of ob/ob mice as a function of dose (log [g construct/kg BW]) using a dimer of the DhCpmFc(−)(Y349C)-GDF15(Ndel3):DhCpmFc(+)(S354C) heterodimer.
Figure 30:
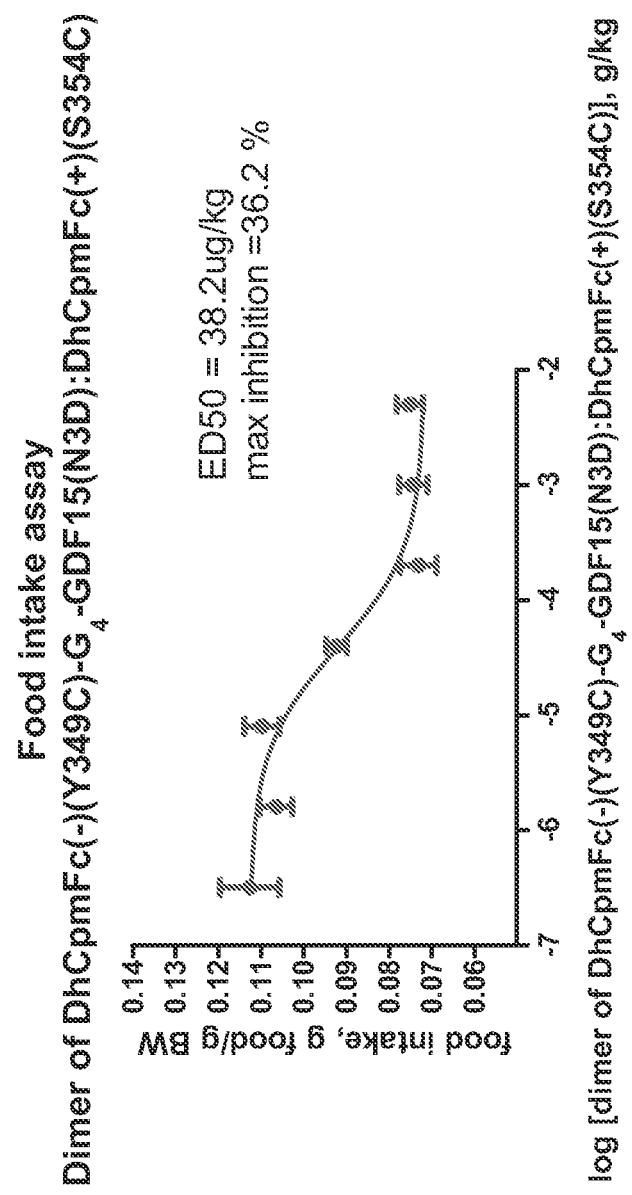
FIG. 30 is a plot showing the effect on food intake (g food/g body weight) of ob/ob mice as a function of dose (log [g construct/kg BW]) using a dimer of the DhCpmFc(−)(Y349C)-G$_4$-GDF15(N3D):DhCpmFc(+)(S354C) heterodimer.
Figure 31:
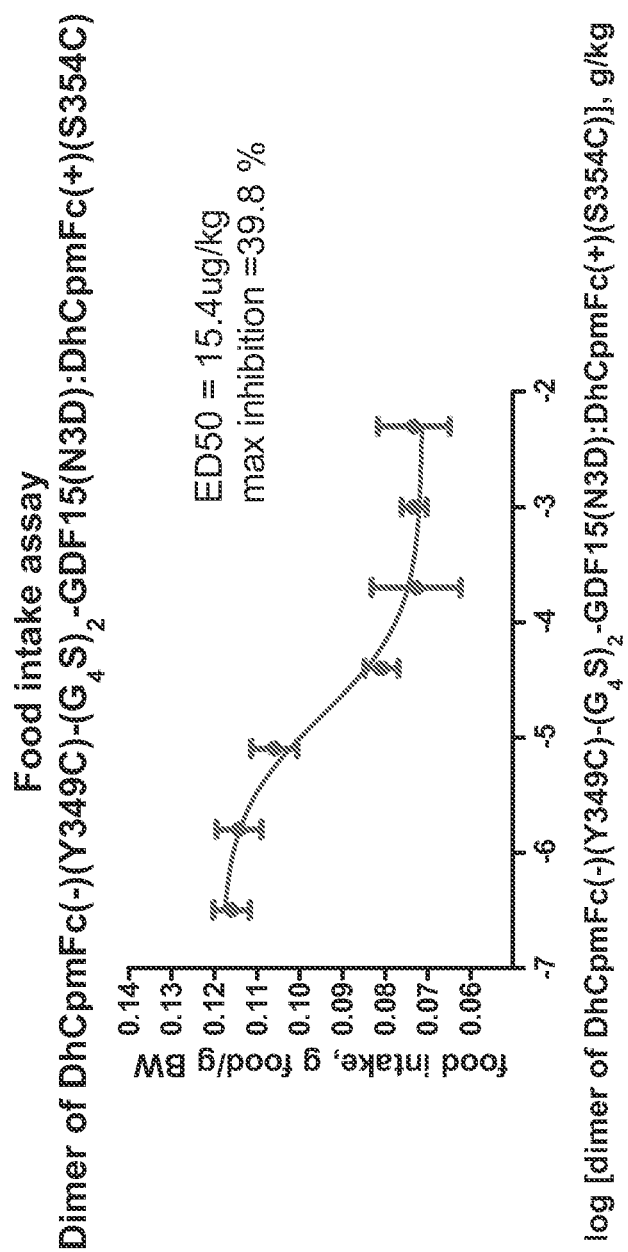
FIG. 31 is a plot showing the effect on food intake (g food/g body weight) of ob/ob mice as a function of dose (log [g construct/kg BW]) using a dimer of the DhCpmFc(−)(Y349C)-(G$_4$S)$_2$-GDF15(N3D):DhCpmFc(+)(S354C) heterodimer.
Figure 32:
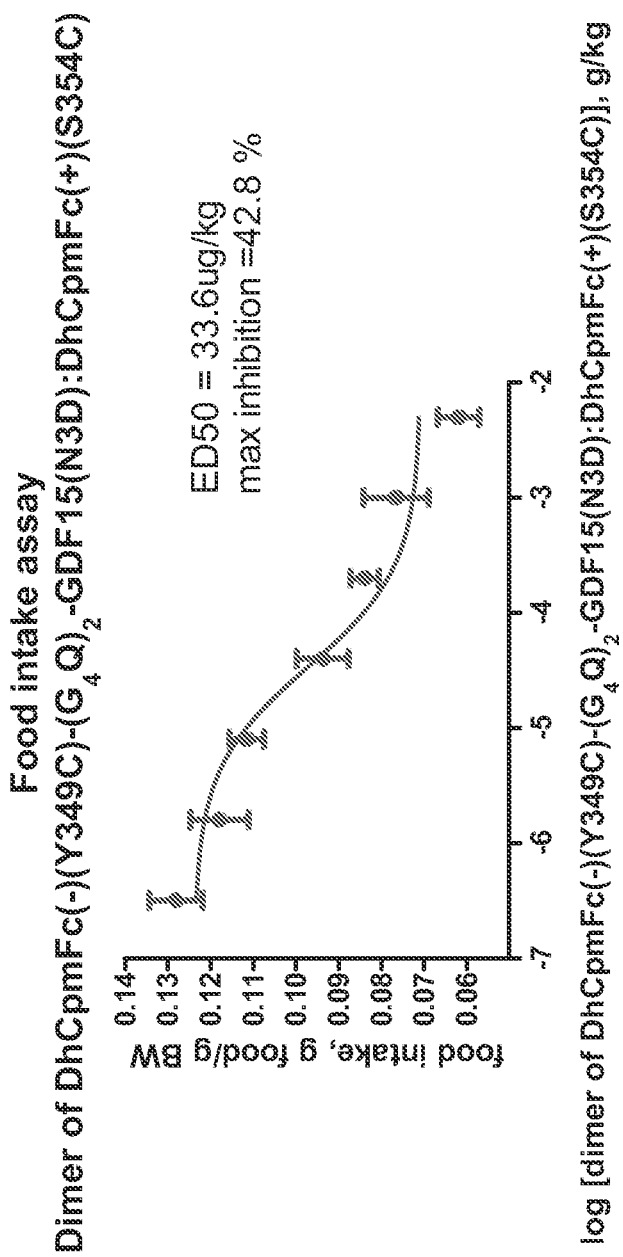
FIG. 32 is a plot showing the effect on food intake (g food/g body weight) of ob/ob mice as a function of dose (log [g construct/kg BW]) using a dimer of the DhCpmFc(−)(Y349C)-(G$_4$Q)$_2$-GDF15(N3D):DhCpmFc(+)(S354C) heterodimer.
Figure 33:
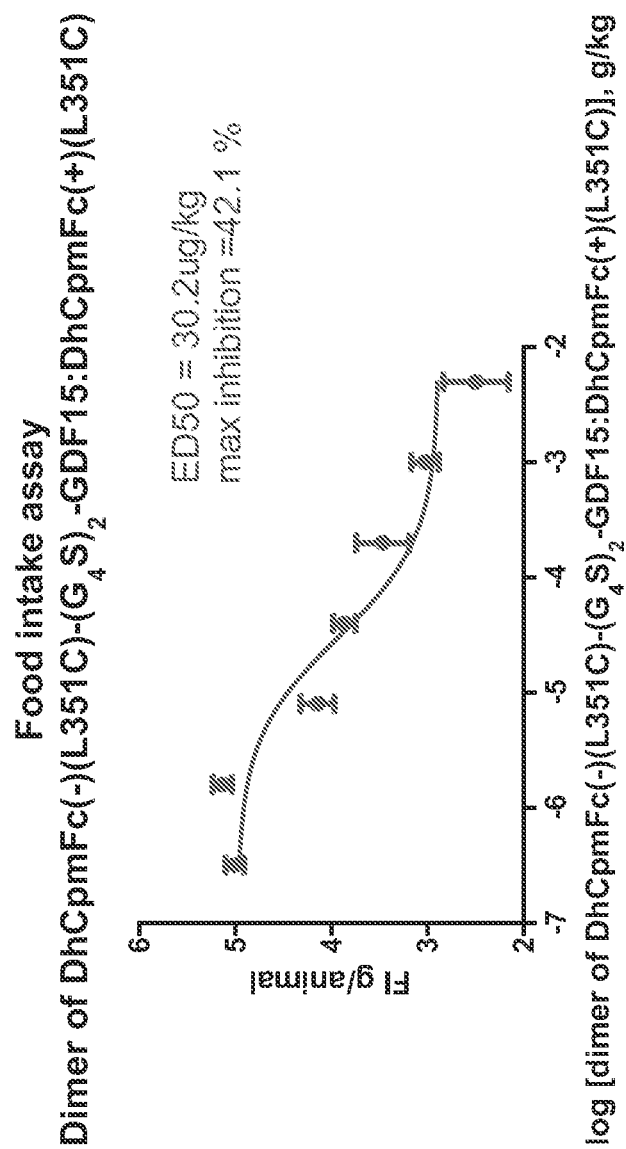
FIG. 33 is a plot showing the effect on food intake (g food/g body weight) of ob/ob mice as a function of dose (log [g construct/kg BW]) using a dimer of the DhCpmFc(−)(L351C)-(G$_4$S)$_2$-GDF15:DhCpmFc(+)(L351C) heterodimer.
Figure 34:
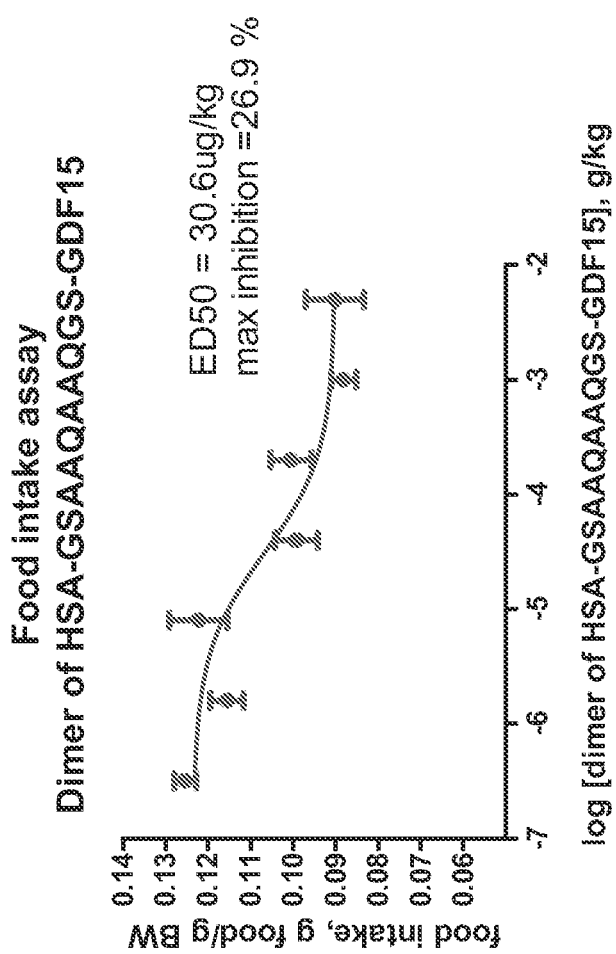
FIG. 34 is a plot showing the effect on food intake (g food/g body weight) of ob/ob mice as a function of dose (log [g construct/kg BW]) using a dimer of the HSA-GSAAQAAQQGS-GDF 15 fusion protein.
Figure 35:
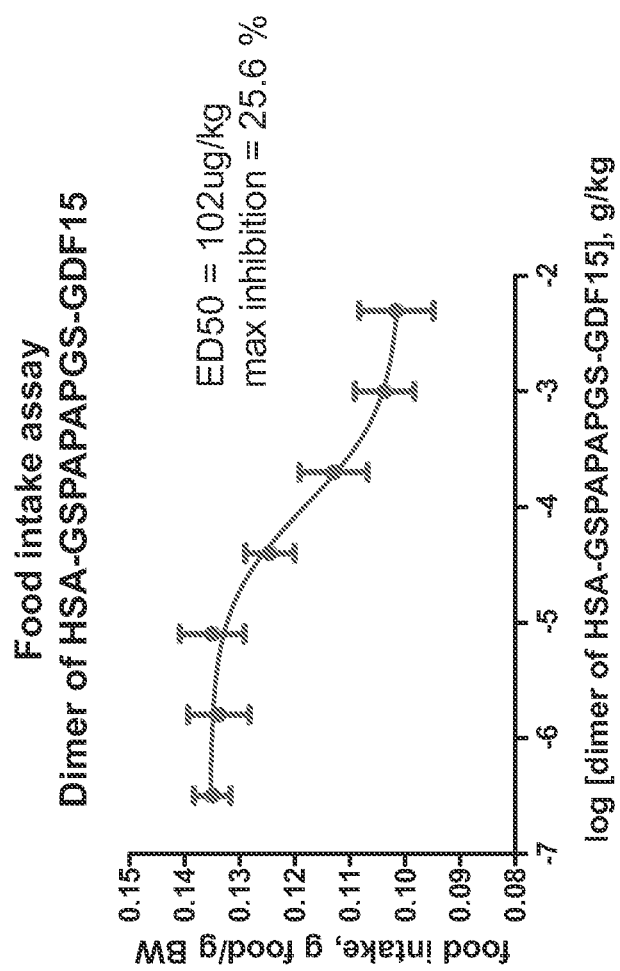
FIG. 35 is a plot showing the effect on food intake (g food/g body weight) of ob/ob mice as a function of dose (log [g construct/kg BW]) using a dimer of the HSA-GSPAPAPGS-GDF 15 fusion protein.
Figure 36:
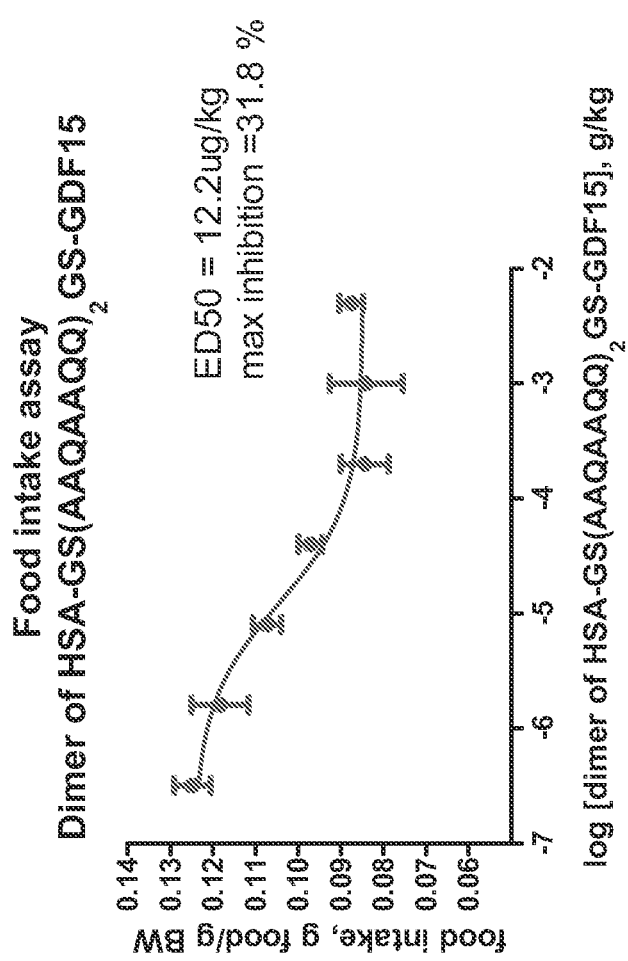
FIG. 36 is a plot showing the effect on food intake (g food/g body weight) of ob/ob mice as a function of dose (log [g construct/kg BW]) using a dimer of the HSA-GS(AAQAAQQ)$_2$GS-GDF15 fusion protein.
Figure 37:
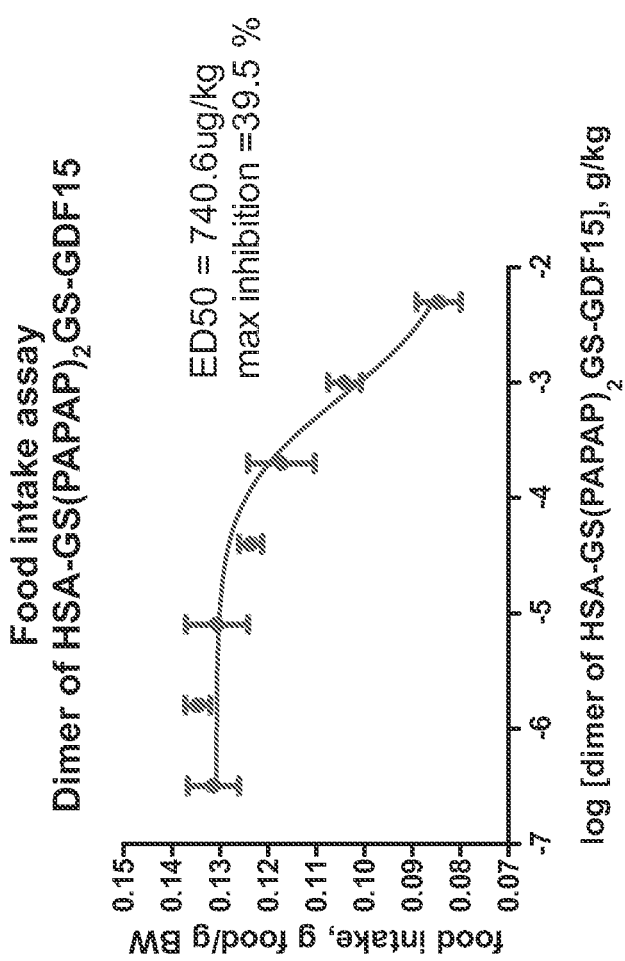
FIG. 37 is a plot showing the effect on food intake (g food/g body weight) of ob/ob mice as a function of dose (log [g construct/kg BW]) using a dimer of the HSA-GS(PAPAP)$_2$ GS-GDF15 fusion protein.
Figure 38:
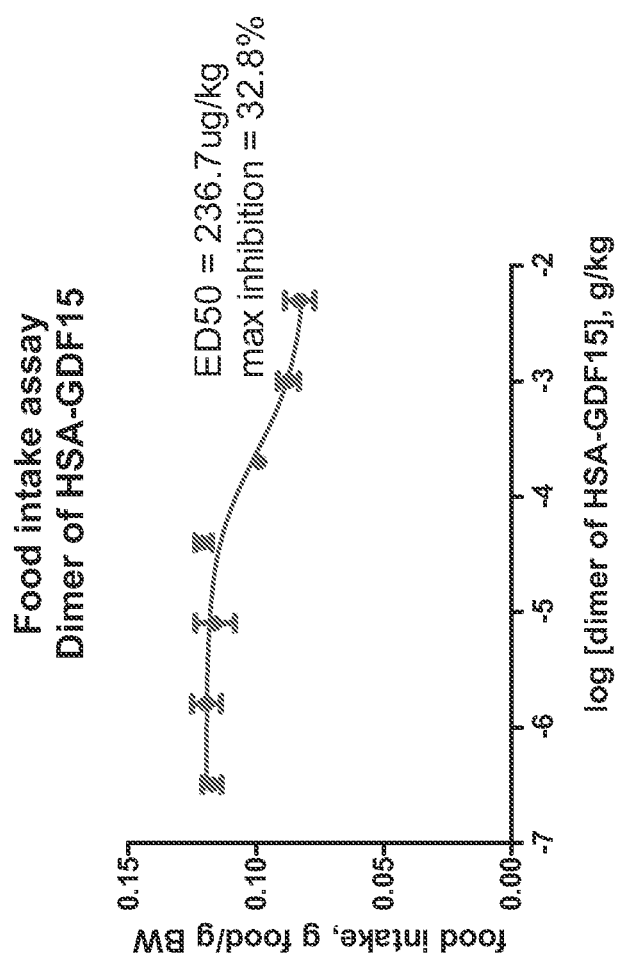
FIG. 38 is a plot showing the effect on food intake (g food/g body weight) of ob/ob mice as a function of dose (log [g construct/kg BW]) using a dimer of the HSA-GDF15 fusion protein.
Figure 39:
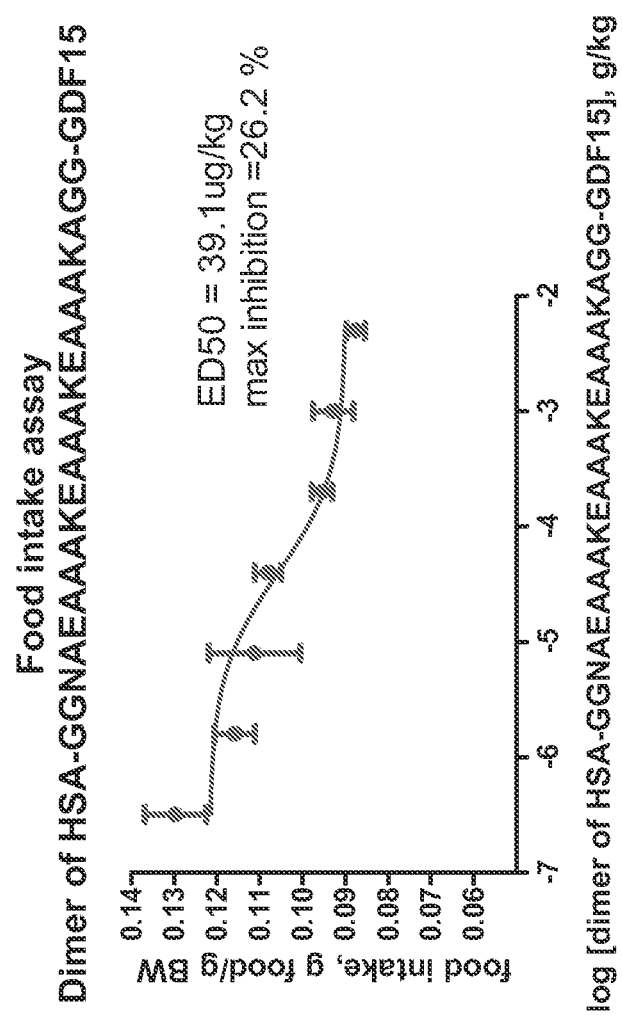
FIG. 39 is a plot showing the effect on food intake (g food/g body weight) of ob/ob mice as a function of dose (log [g construct/kg BW]) using a dimer of the HSA-GGNAE-AAAKEAAAKEAAAKAGG-GDF 15 fusion protein.
Figure 40:
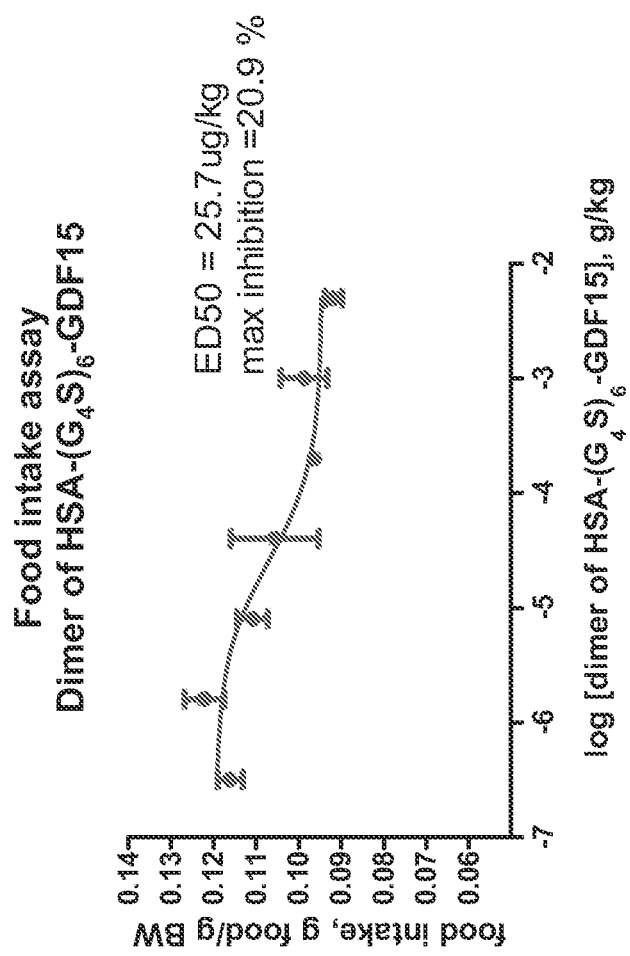
FIG. 40 is a plot showing the effect on food intake (g food/g body weight) of ob/ob mice as a function of dose (log [g construct/kg BW]) using a dimer of the HSA-(G$_4$S)$_6$-GDF15 fusion protein.
Figure 41:
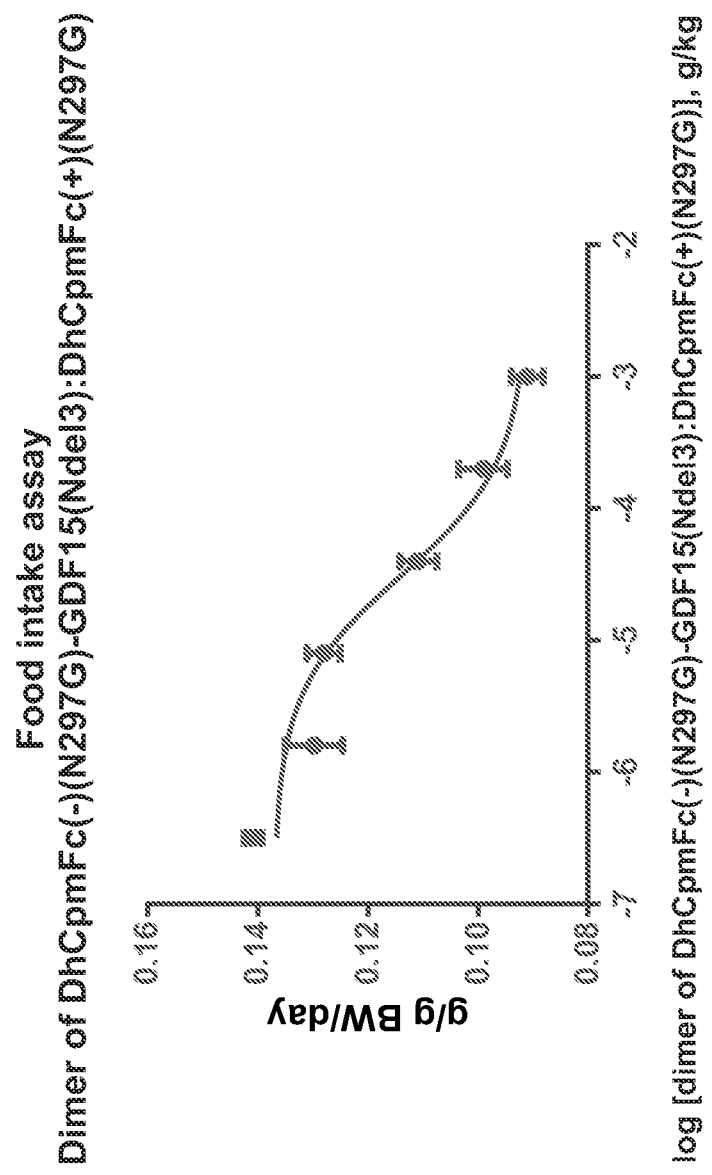
FIG. 41 is a plot showing the effect on food intake (g food/g body weight) of ob/ob mice as a function of dose (log [g construct/kg BW]) using a dimer of the DhCpmFc(−)(N297G)-GDF15(Ndel3):DhCpmFc(+)(N297G) heterodimer.
Figure 42:
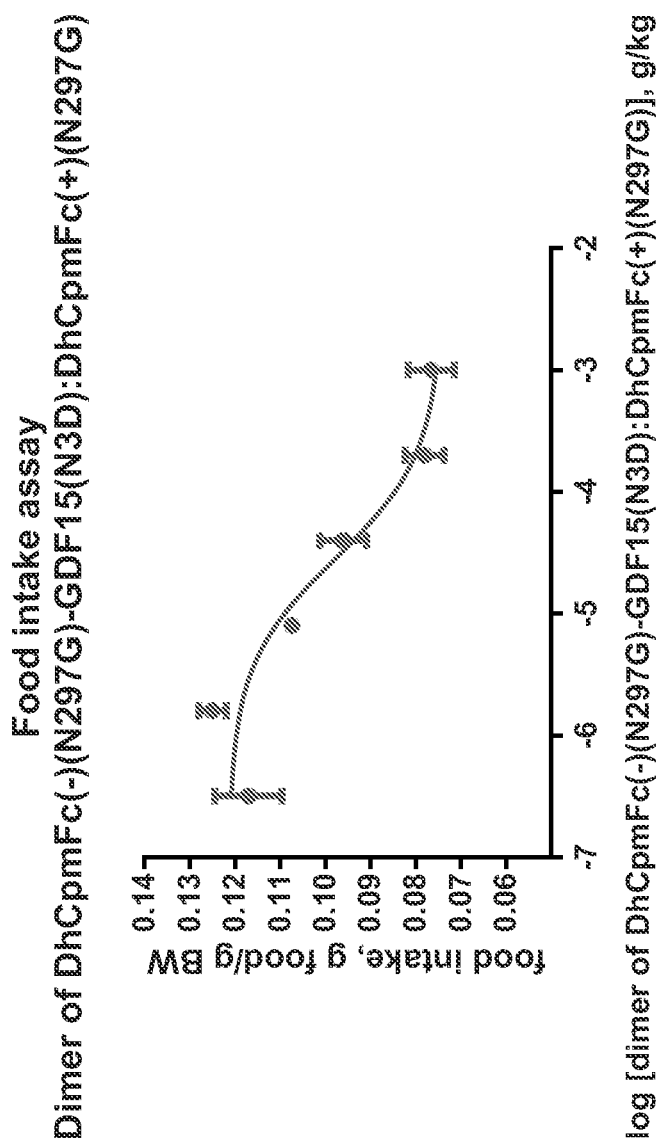
FIG. 42 is a plot showing the effect on food intake (g food/g body weight) of ob/ob mice as a function of dose (log [g construct/kg BW]) using a dimer of the DhCpmFc(−)(N297G)-GDF15(N3D):DhCpmFc(+)(N297G) heterodimer.
Figure 43:
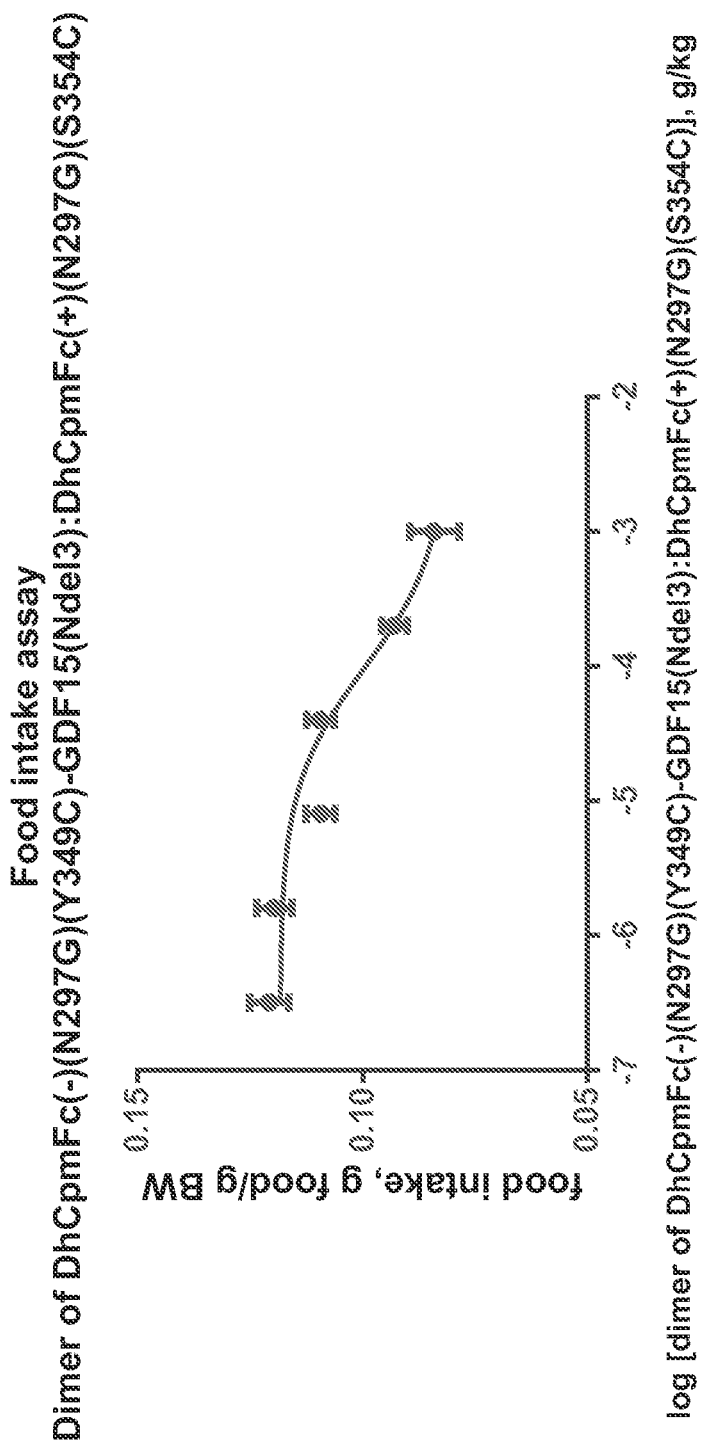
FIG. 43 is a plot showing the effect on food intake (g food/g body weight) of ob/ob mice as a function of dose (log [g construct/kg BW]) using a dimer of the DhCpmFc(−)(N297G)(Y349C)-GDF15(Ndel3):DhCpmFc(+)(N297G)(S354C) heterodimer.
Figure 44:
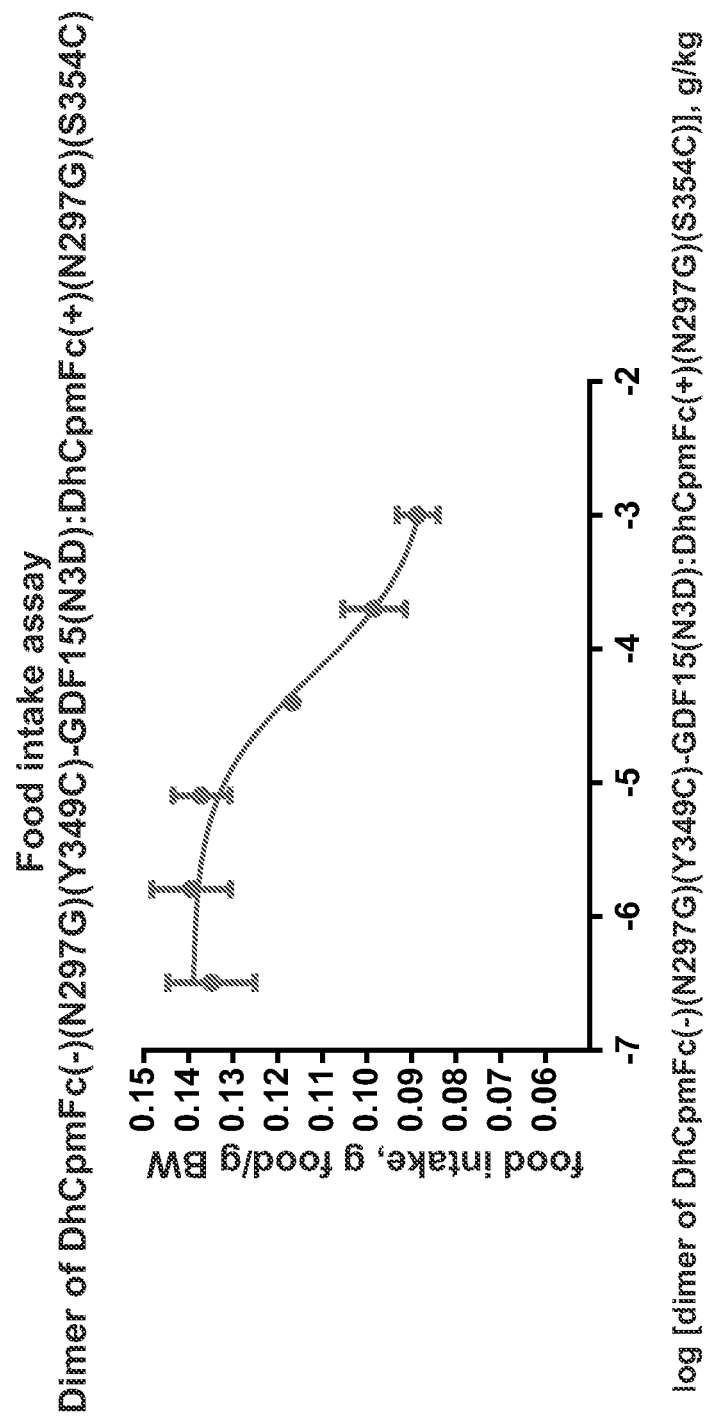
FIG. 44 is a plot showing the effect on food intake (g food/g body weight) of ob/ob mice as a function of dose (log [g construct/kg BW]) using a dimer of the DhCpmFc(−)(N297G)(Y349C)-GDF15(N3D):DhCpmFc(+)(N297G)(S354C) heterodimer.
Figure 45:
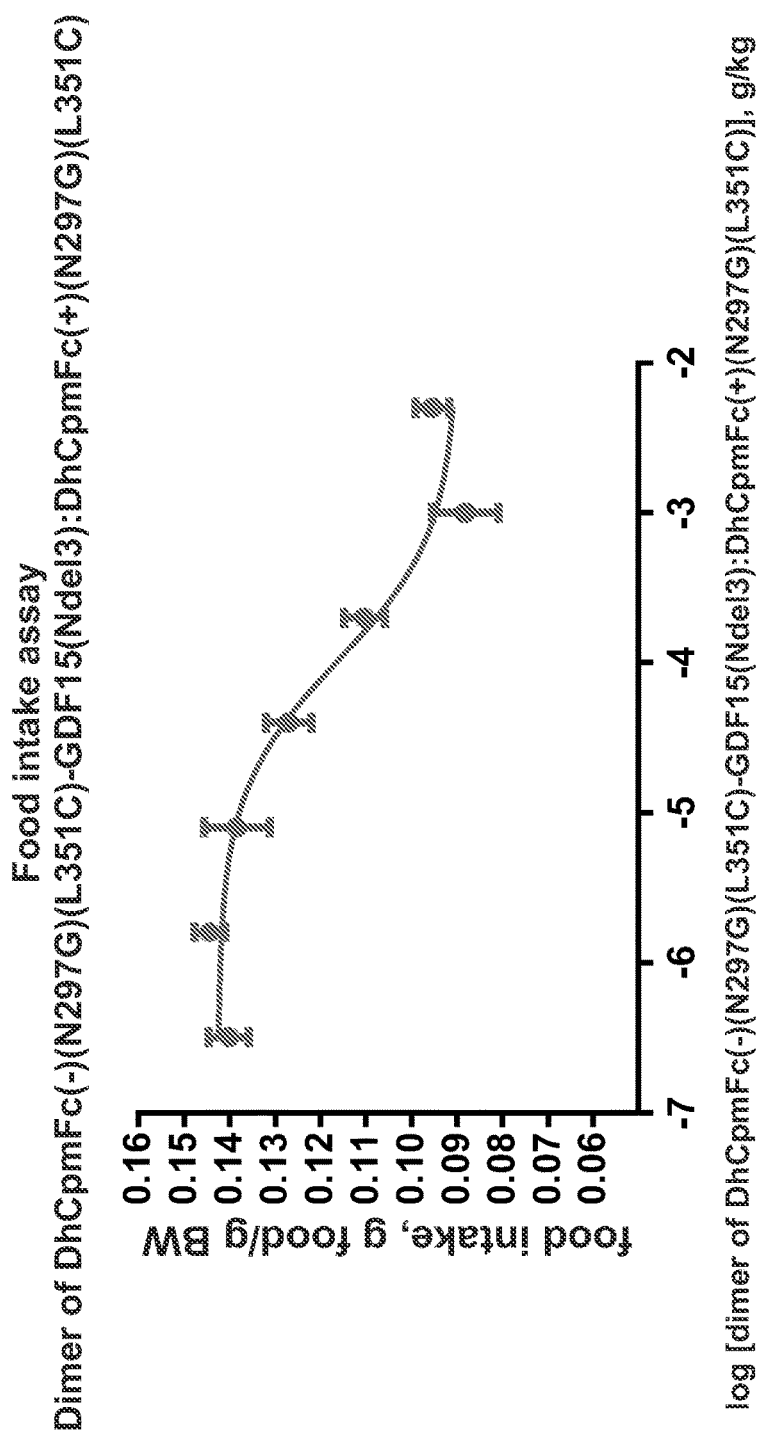
FIG. 45 is a plot showing the effect on food intake (g food/g body weight) of ob/ob mice as a function of dose (log [g construct/kg BW]) using a dimer of the DhCpmFc(−)(N297G)(L351C)-GDF15(Ndel3):DhCpmFc(+)(N297G)(L351C) heterodimer.
Figure 46:
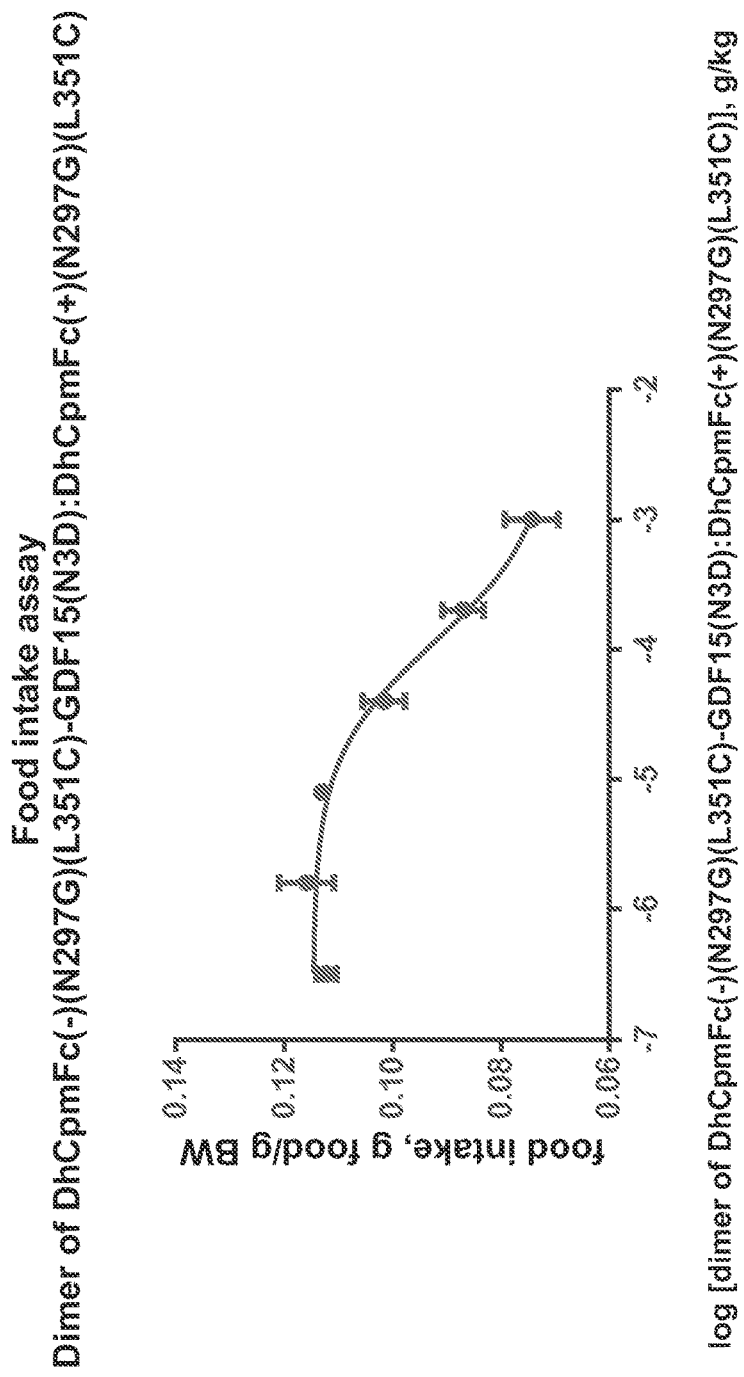
FIG. 46 is a plot showing the effect on food intake (g food/g body weight) of ob/ob mice as a function of dose (log [g construct/kg BW]) using a dimer of the DhCpmFc(−)(N297G)(L351C)-GDF15(N3D):DhCpmFc(+)(N297G)(L351C) heterodimer.
Figure 47:
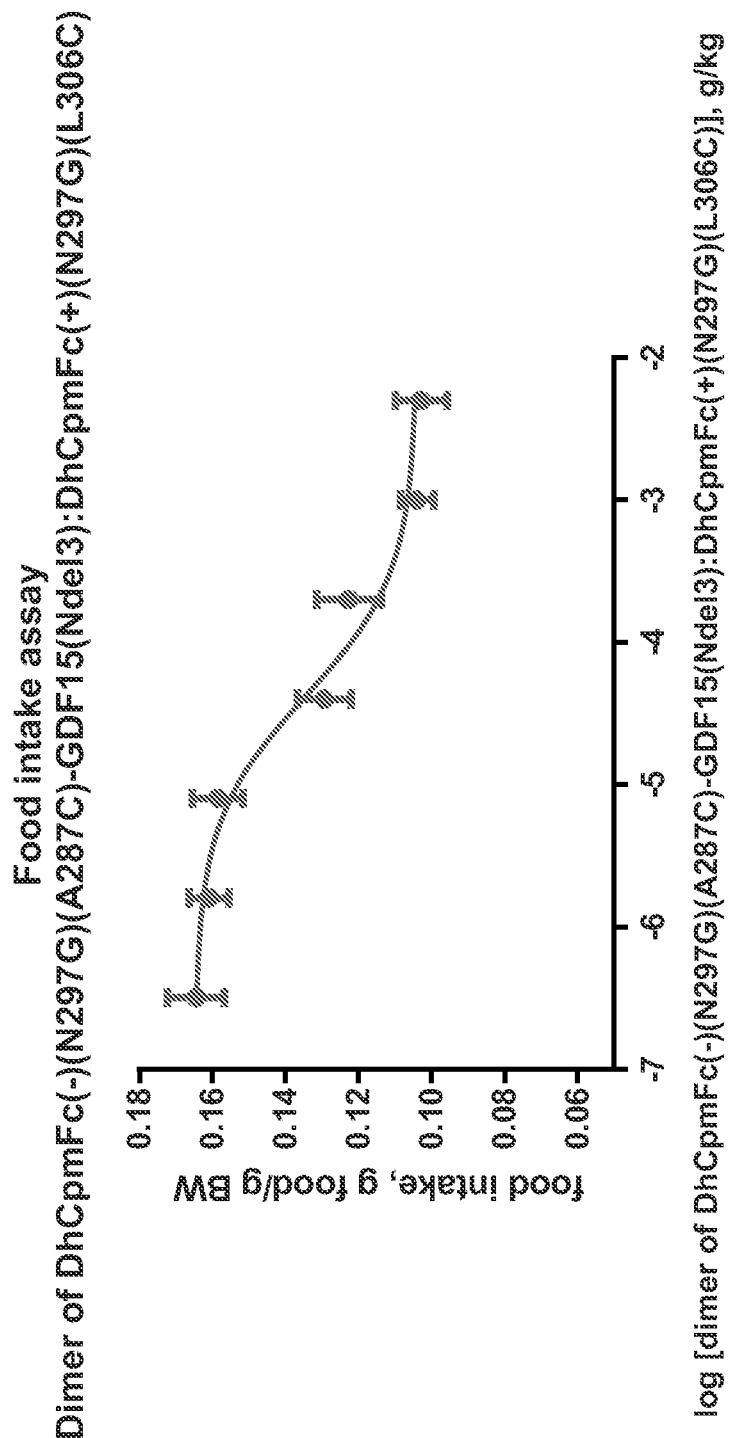
FIG. 47 is a plot showing the effect on food intake (g food/g body weight) of ob/ob mice as a function of dose (log [g construct/kg BW]) using a dimer of the DhCpmFc(−)(N297G)(A287C)-GDF15(Ndel3):DhCpmFc(+)(N297G)(L306C) heterodimer.
Figure 48:
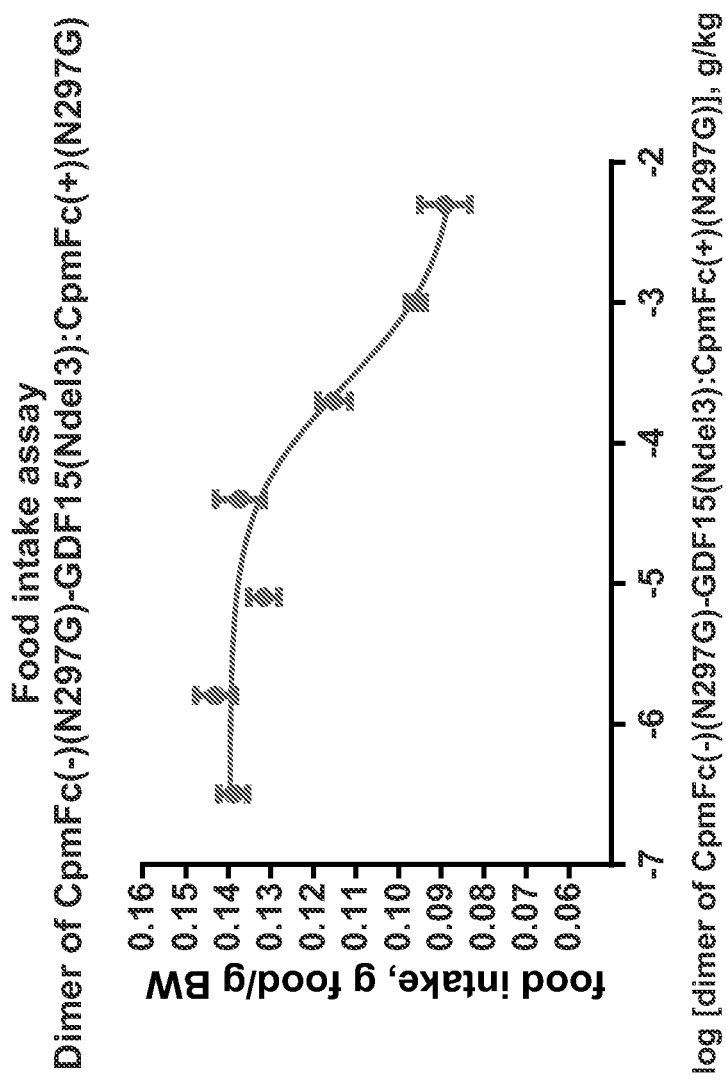
FIG. 48 is a plot showing the effect on food intake (g food/g body weight) of ob/ob mice as a function of dose (log [g construct/kg BW]) using a dimer of the CpmFc(−)(N297G)-GDF15(Ndel3):CpmFc(+)(N297G) heterodimer.
Figure 49:
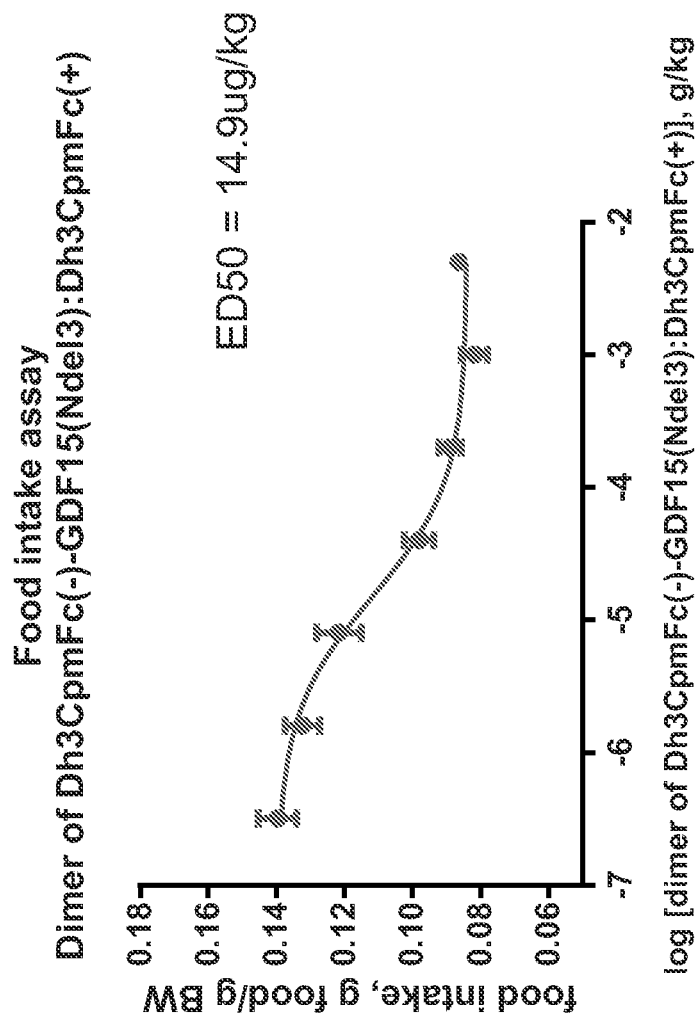
FIG. 49 is a plot showing the effect on food intake (g food/g body weight) of ob/ob mice as a function of dose (log [g construct/kg BW]) using a dimer of the Dh3CpmFc(−)-GDF15(Ndel3):Dh3CpmFc(N297G) heterodimer.
Figure 50:
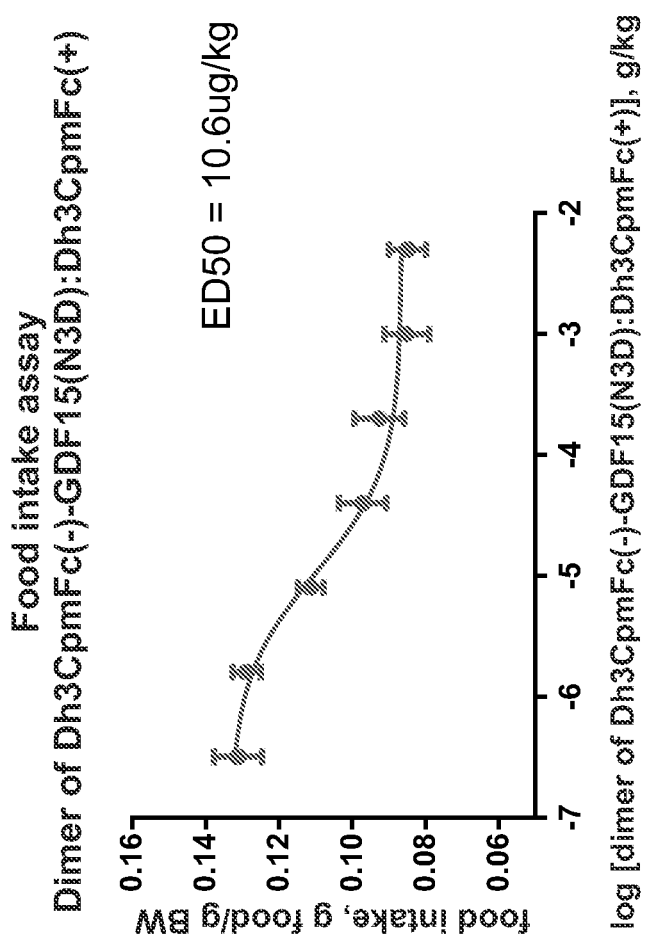
FIG. 50 is a plot showing the effect on food intake (g food/g body weight) of ob/ob mice as a function of dose (log [g construct/kg BW]) using a dimer of the Dh3CpmFc(−)-GDF15(N3D):Dh3CpmFc(+)(N297G) heterodimer.
Figure 51:
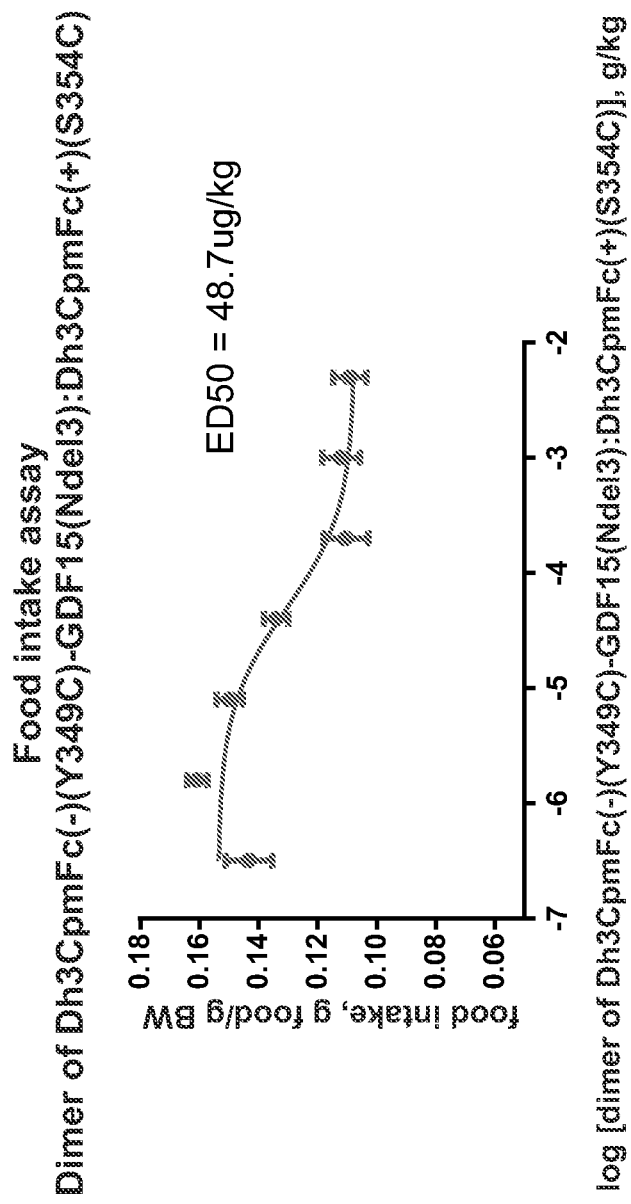
FIG. 51 is a plot showing the effect on food intake (g food/g body weight) of ob/ob mice as a function of dose (log [g construct/kg BW]) using a dimer of the Dh3CpmFc(−)(Y349C)-GDF15(Ndel3):Dh3CpmFc(+)(N297G)(S354C) heterodimer.
Figure 52:
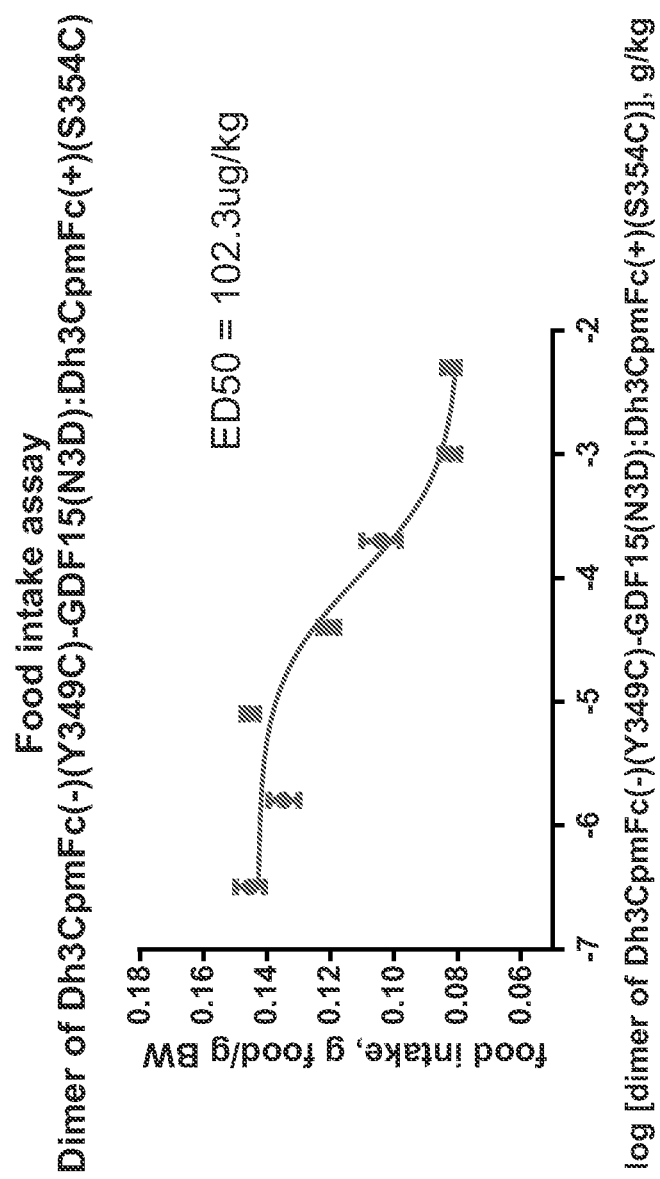
FIG. 52 is a plot showing the effect on food intake (g food/g body weight) of ob/ob mice as a function of dose (log [g construct/kg BW]) using a dimer of the Dh3CpmFc(−)(Y349C)-GDF15(N3D):Dh3CpmFc(−)(N297G)(S354C) heterodimer.
Figure 53:
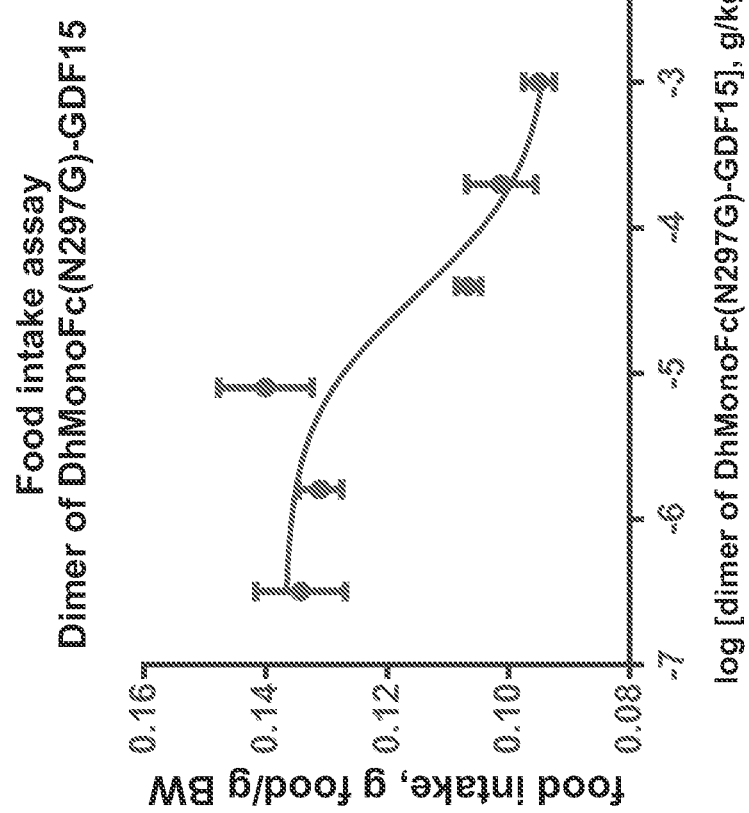
FIG. 53 is a plot showing the effect on food intake (g food/g body weight) of ob/ob mice as a function of dose (log [g construct/kg BW]) using a dimer of the DhMonoFc(N297G)-GDF15 fusion protein.
Figure 54:
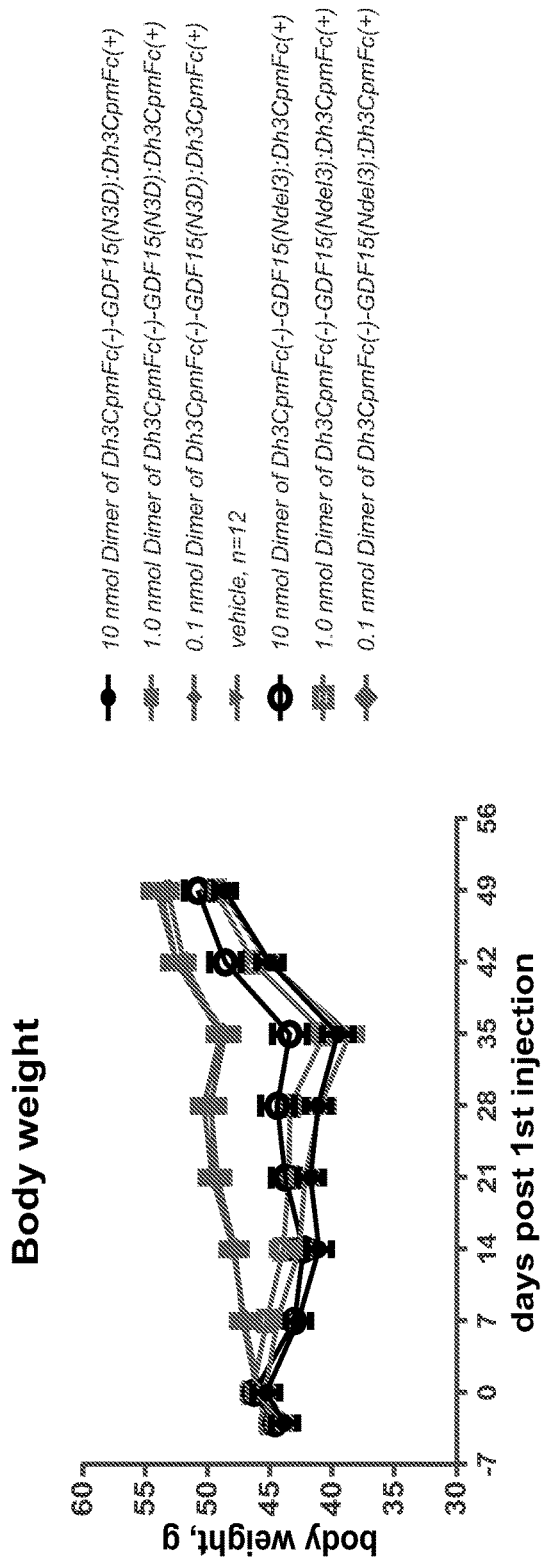
FIG. 54 is a plot of body weight (g) as a function of time (days post 1$^{st}$ injection) for vehicle, 0.1 nmol, 1 nmol and 10 nmol of a dimer of the Dh3CpmFc(−)-GDF15(N3D):Dh3CpmFc(+) heterodimer, and 0.1 nmol, 1 nmol and 10 nmol of a dimer of the Dh3ComFc(−)-GDF15(Ndel3) heterodimer.
Figure 55:
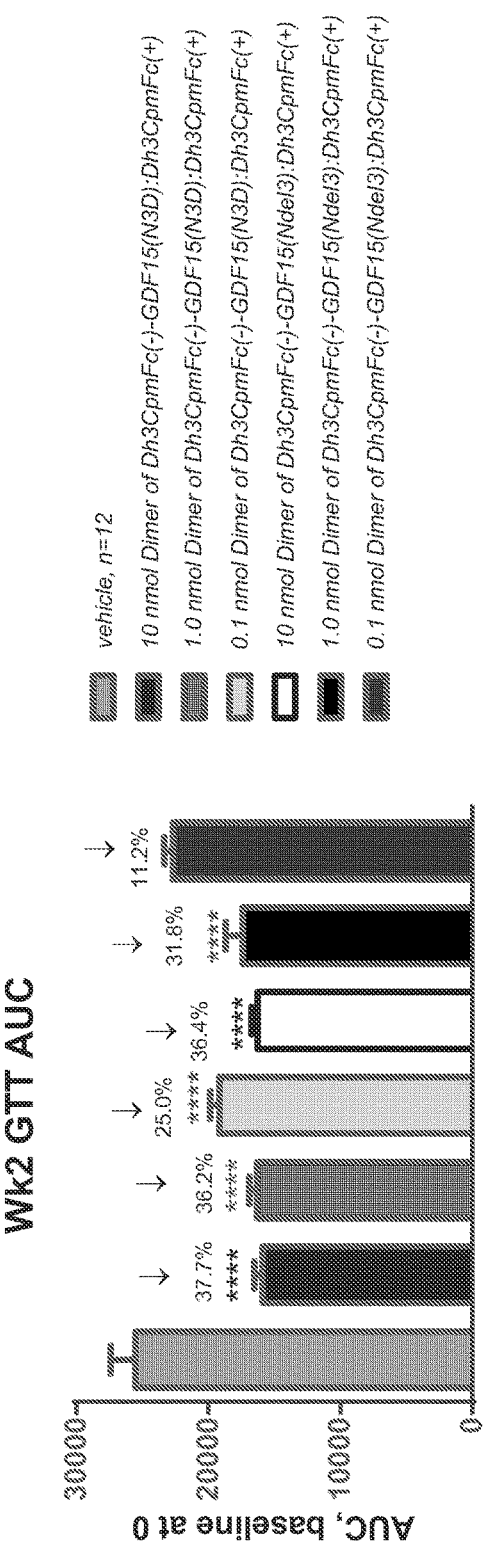
FIG. 55 is a bar graph of area under the curve (AUC) for a glucose tolerance test at week 2 of treatment with (a) vehicle (b) 10 mmol of a dimer of the Dh3CpmFc(−)-GDF15(N3D):Dh3CpmFc(+) heterodimer (c) 1 mmol of a dimer of the Dh3CpmFc(−)-GDF15(N3D):Dh3CpmFc(+) heterodimer, (d) 0.1 mmol of a dimer of the Dh3CpmFc(−)-GDF15(N3D):Dh3CpmFc(+) heterodimer, (e) 10 mmol of a dimer of the Dh3CpmFc(−)-GDF15(Ndel3):Dh3CpmFc(+) heterodimer (g) 1 mmol of a dimer of the Dh3CpmFc(−)-GDF15(Ndel3):Dh3CpmFc(+) heterodimer, or (g) 0.1 mmol of a dimer of the Dh3CpmFc(−)-GDF15(Ndel):Dh3CpmFc(+) heterodimer.
Figure 56:
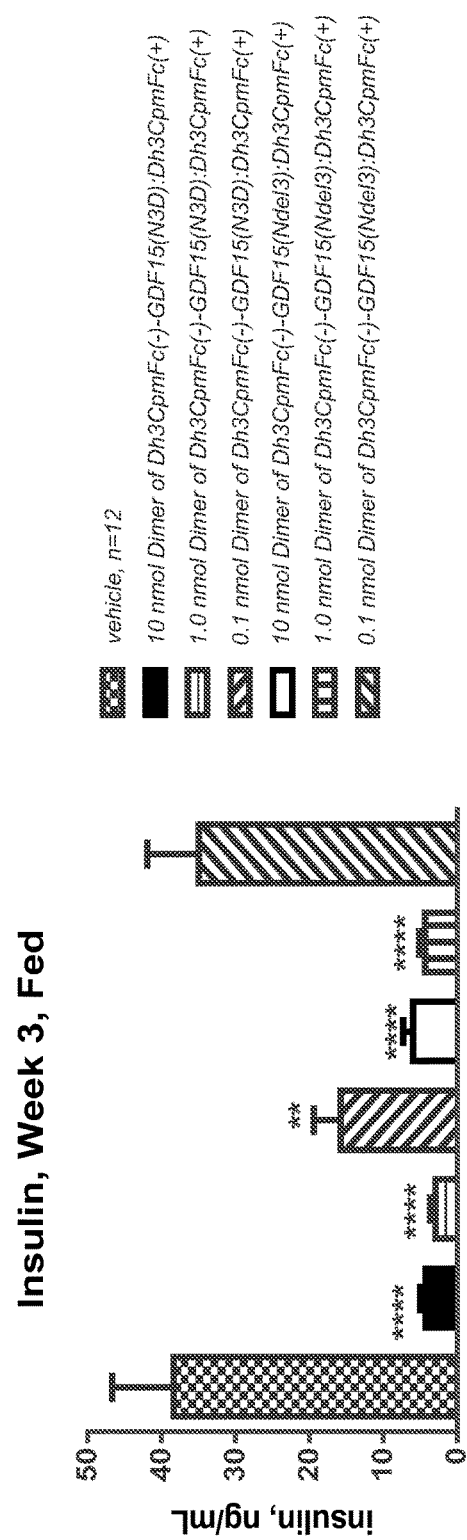
FIG. 56 is a bar graph of insulin (ng/mL) (fed) at week 3 of treatment with (a) vehicle (b) 10 mmol of a dimer of the Dh3CpmFc(−)-GDF15(N3D):Dh3CpmFc(+) heterodimer (c) 1 mmol of a dimer of the Dh3CpmFc(−)-GDF15(N3D):Dh3CpmFc(+) heterodimer, (d) 0.1 mmol of a dimer of the Dh3CpmFc(−)-GDF15(N3D):Dh3CpmFc(+) heterodimer, (e) 10 mmol of a dimer of the Dh3CpmFc(−)-GDF15(Ndel3):Dh3CpmFc(+) heterodimer (g) 1 mmol of a dimer of the Dh3CpmFc(−)-GDF15(Ndel3):Dh3CpmFc(+) heterodimer, or (g) 0.1 mmol of a dimer of the Dh3CpmFc(−)-GDF15(Ndel):Dh3CpmFc(+) heterodimer.

In certain embodiments, a homodimer is provided comprising two such fusion proteins linked via an interchain disulfide bond between their respective GDF15 regions. See FIG. 6 for a graphic depiction of an embodiment of such a homodimer. Alternatively, a heterodimer is provided comprising one such fusion protein and a GDF15 polypeptide or GDF mutant polypeptide, linked via an interchain disulfide bond between the GDF15 region of the fusion protein and the GDF15 polypeptide or mutant polypeptide.

II.G.1 HSA-(G$_4$S)$_4$-GDF15:GDF15 Heterodimer

The designation "HSA-(G$_4$S)$_4$-GDF15:GDF15" in the instant disclosure refers to a heterodimer comprising (i) a first polypeptide chain comprising a GDF15 polypeptide linked to an HSA polypeptide via a linker comprising the sequence of SEQ ID NO:18 that connects the N-terminus of the GDF15 polypeptide to the C-terminus of the HSA polypeptide, and (ii) a second polypeptide chain comprising a GDF15 polypeptide.

Typically, the first and second polypeptide chains are linked via an interchain disulfide bond between their respective GDF15 regions.

More particularly, in a specific embodiment, the heterodimer comprises:

(a) one HSA polypeptide (first monomer) comprising the sequence:

(SEQ ID NO: 110)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL, and (b) two GDF15 polypeptides (one each monomer) comprising the sequence of SEQ ID NO:12, and (c) one polypeptide linker (first monomer) comprising the sequence of SEQ ID NO:18 linking the N-terminus of a GDF15 polypeptide to the C-terminus of the HSA polypeptide via a peptide bond.

In a preferred embodiment, the first polypeptide comprises the amino acid sequence (linker double underlined):

(SEQ ID NO: 112)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL<u>GGGGSGGGGSGGGGS

GGGGS</u>ARNGDHCPLGPGRCCRLHTVRASLEDLGWADWVLSPREVQVTMCI

GACPSQFRAANMHAQIKTSLHRLKPDTVPAPCCVPASYNPMVLIQKTDTG

VSLQTYDDLLAKDCHCI, which is encoded by the nucleic acid sequence:

(SEQ ID NO: 111)
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag accagaggttgatgtgatgtgcactgcttttcatgacaatgaagagacat ttttgaaaaaatacttatatgaaattgccagaagacatccttacttttat gccccggaactccttttctttgctaaaaggtataaagctgcttttacaga atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct gacttgccttcattagctgctgattttgttgaaagtaaggatgtttgcaa aaactatgctgaggcaaaggatgtcttcctgggcatgtttttgtatgaat atgcaagaaggcatcctgattactctgtcgtgctgctgctgagacttgcc aagacatatgaaaccactctagagaagtgctgtgccgctgcagatcctca tgaatgctatgccaaagtgttcgatgaatttaaacctcttgtggaagagc ctcagaatttaatcaaacaaaattgtgagcttttttgagcagcttggagag tacaaattccagaatgcgctattagttcgttacaccaagaaagtacccca -continued

```
agtgtcaactccaactcttgtagaggtctcaagaaacctaggaaaagtgg gcagcaaatgttgtaaacatcctgaagcaaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg ctttgccgaggagggtaaaaaacttgttgcggccagtcaggccgccttag gcttaggaggtggtggatccggaggcggtggaagcggaggtggtggatct ggaggcggtggaagcgcgcgcaacggagaccactgtccgctcgggccgg gcgttgctgccgtctgcacacggtccgcgcgtcgctggaagacctgggct gggccgattgggtgctgtcgccacgggaggtgcaagtgaccatgtgcatc ggcgcgtgcccgagccagttccgggcggcaaacatgcacgcgcagatcaa gacgagcctgcaccgcctgaagcccgacacggtgccagcgccctgctgcg tgcccgccagctacaatcccatggtgctcattcaaaagaccgacaccggg gtgtcgctccagacctatgatgacttgttagccaaagactgccactgcat atga.
```

In a preferred embodiment, the second polypeptide chain comprises the amino acid sequence of SEQ ID NO:12, which is encoded by the nucleic acid sequence of SEQ ID NO:11.

As discussed above, a heterodimer is provided comprising a first polypeptide chain having the sequence of SEQ ID NO:112 and a second polypeptide chain having the sequence of SEQ ID NO:12.

II.G.2 HSA-(G₄S)₄-GDF15

The designation "HSA-(G₄S)₄-GDF15" in the instant disclosure refers to a fusion protein comprising a GDF15 polypeptide linked to an HSA polypeptide via a linker comprising the sequence of SEQ ID NO:18 that connects the N-terminus of the GDF15 polypeptide to the C-terminus of the HSA polypeptide.

In certain embodiments, a homodimer is provided comprising two HSA-(G₄S)₄-GDF15 fusion proteins, linked via an interchain disulfide bond between their respective GDF15 regions.

More particularly, in a specific embodiment, the homodimer comprises:
 (a) two HSA polypeptides (one each monomer) comprising the sequence of SEQ ID NO:110;
 (b) two GDF15 polypeptides (one each monomer) comprising the sequence of SEQ ID NO:12, and
 (c) two polypeptide linkers (one each monomer) comprising the sequence of SEQ ID NO:18 each linking the N-terminus of a GDF15 polypeptide to the C-terminus of an HSA polypeptide via a peptide bond.

In a preferred embodiment, the fusion protein comprises the amino acid sequence of SEQ ID NO:112, which is encoded by the nucleic acid sequence of SEQ ID NO:111.

As discussed above, in a specific embodiment, a homodimer is provided comprising two fusion proteins having the sequence of SEQ ID NO:112.

II.G.3 HSA-GSPAPAPGS-GDF15

The designation "HSA-(GSPAPAPGS)-GDF15" in the instant disclosure refers to a fusion protein comprising a GDF15 polypeptide linked to an HSA polypeptide via a linker comprising the sequence of SEQ ID NO:113 that connects the N-terminus of the GDF15 polypeptide to the C-terminus of the HSA polypeptide.

In certain embodiments, a homodimer is provided comprising two HSA-(GSPAPAPGS)-GDF15 fusion proteins, linked via an interchain disulfide bond between their respective GDF15 regions.

More particularly, in a specific embodiment, the homodimer comprises:
 (a) two HSA polypeptides (one each monomer) comprising the sequence of SEQ ID NO:110;
 (b) two GDF15 polypeptides (one each monomer) comprising the sequence of SEQ ID NO:12; and
 (c) two polypeptide linkers (one each monomer) comprising the sequence:
GSPAPAPGS (SEQ ID NO:113)
each linking the N-terminus of the GDF-15 polypeptide to the C-terminus of the HSA polypeptide via a peptide bond.

In a preferred embodiment, the fusion protein comprises the amino acid sequence (linker double underlined):

(SEQ ID NO: 115)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL<u>GSPAPAPGS</u>ARNGDH

CPLGPGRCCRLHTVRASLEDLGWADWVLSPREVQVTMCIGACPSQFRAAN

MHAQIKTSLHRLKPDTVPAPCCVPASYNPMVLIQKTDTGVSLQTYDDLLA

KDCHCI, which is encoded by the nucleic acid sequence:

(SEQ ID NO: 114)
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag
```

-continued
```
accagaggttgatgtgatgtgcactgcttttcatgacaatgaagagacat ttttgaaaaaatacttatatgaaattgccagaagacatccttactttat gccccggaactccttttctttgctaaaaggtataaagctgcttttacaga atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct gacttgccttcattagctgctgattttgttgaaagtaaggatgtttgcaa aaactatgctgaggcaaaggatgtcttcctgggcatgtttttgtatgaat atgcaagaaggcatcctgattactctgtcgtgctgctgctgagacttgcc aagacatatgaaaccactctagagaagtgctgtgccgctgcagatcctca tgaatgctatgccaaagtgttcgatgaatttaaacctcttgtggaagagc ctcagaatttaatcaaacaaattgtgagcttttgagcagcttggagag tacaaattccagaatgcgctatagttcgttacaccaagaaagtacccca agtgtcaactccaactcttgtagaggtctcaagaaacctaggaaagtgg gcagcaaatgttgtaaacatcctgaagcaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg cttttgccgaggagggtaaaaaacttgttgcggccagtcaggccgcctag gcttaggatccccagctccagctccaggaagcgcgcgcaacggagaccac tgtccgctcgggcccgggcgttgctgccgtctgcacacggtccgcgcgtc gctggaagacctgggctgggccgattgggtgctgtcgccacgggaggtgc aagtgaccatgtgcatcggcgcgtgcccgagccagttccgggcggcaaac atgcacgcgcagatcaagacgagcctgcaccgcctgaagcccgacacggt gccagcgccctgctgcgtgcccgccagctacaatcccatggtgctcattc aaaagaccgacaccggggtgtcgctccagacctatgatgacttgttagcc aaagactgccactgcatatga.
```

As discussed above, in a specific embodiment, a homodimer is provided comprising two fusion proteins having the sequence of SEQ ID NO:115.

II.G.4 HSA-GS(PAPAP)₂GS-GDF15

The designation "HSA-GS(PAPAP)₂GS-GDF15" in the instant disclosure refers to a fusion protein comprising a GDF15 polypeptide linked to an HSA polypeptide via a linker comprising the sequence of SEQ ID NO:116 that connects the N-terminus of the GDF15 polypeptide to the C-terminus of the HSA polypeptide.

In certain embodiments, a homodimer is provided comprising two HSA-GS(PAPAP)₂GS-GDF15 fusion proteins, linked via an interchain disulfide bond between their respective GDF15 regions.

More particularly, in a specific embodiment, the homodimer comprises:

(a) two HSA polypeptides (one each monomer) comprising the sequence of SEQ ID NO:110;

(b) two GDF15 polypeptides (one each monomer) comprising the sequence of SEQ ID NO:12; and (c) two polypeptide linkers (one each monomer) comprising the sequence:
GSPAPAPPAPAPGS (SEQ ID NO:116)
each linking the N-terminus of the GDF-15 polypeptide to the C-terminus of the HSA polypeptide via a peptide bond.

In a preferred embodiment, the fusion protein comprises the amino acid sequence (linker double underlined):

(SEQ ID NO: 118)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASGAALGL<u>GSPAPAPPAPAPGSA</u>

RNGDHCPLGPGRCCRLHTVRASLEDLGWADWVLSPREVQVTMCIGACPSQ

FRAANMHAQIKTSLHRLKPDTVPAPCCVPASYNPMVLIQKTDTGVSLQTY

DDLLAKDCHCI, which is encoded by the nucleic acid sequence:

(SEQ ID NO: 117)
```
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag accagaggttgatgtgatgtgcactgcttttcatgacaatgaagagacat ttttgaaaaaatacttatatgaaattgccagaagacatccttactttat gccccggaactccttttctttgctaaaaggtataaagctgcttttacaga
```

-continued
```
atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtgaaaatgatgagatgcctgct gacttgccttcattagctgctgattttgttgaaagtaaggatgtttgcaa aaactatgctgaggcaaaggatgtcttcctgggcatgttttgtatgaat atgcaagaaggcatcctgattactctgtcgtgctgctgctgagacttgcc aagacatatgaaaccactctagagaagtgctgtgccgctgcagatcctca tgaatgctatgccaaagtgttcgatgaatttaaacctcttgtggaagagc ctcagaatttaatcaaacaaaattgtgagcttttgagcagcttggagag tacaaattccgaatgcgctattagttcgttacaccaagaaagtacccca agtgtcaactccaactcttgtagaggtctcaagaaacctaggaaaagtgg gcagcaaatgttgtaaacatcctgaagcaaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg ctttgccgaggagggtaaaaaacttgttgcggccagtcaggccgcctag gcttaggatccccagctccagctccacccgcacctgcccctggaagcgcg cgcaacggagaccactgtccgctcgggcccgggcgttgctgccgtctgca cacggtccgcgcgtcgctggaagacctgggctgggccgattgggtgctgt cgccacgggaggtgcaagtgaccatgtgcatcggcgcgtgcccgagccag ttccgggcggcaaacatgcacgcgcagatcaagacgagcctgcaccgcct gaagcccgacacggtgccagcgcctgctgcgtgcccgccagctacaatc ccatggtgctcattcaaaagaccgacaccggggtgtcgctccagacctat gatgacttgttagccaaagactgccactgcatatga.
```

As discussed above, in a specific embodiment, a homodimer is provided comprising two fusion proteins having the sequence of SEQ ID NO:118.

II.G.5 HSA-GSAAQAAQQGS-GDF15

The designation "HSA-GSAAQAAQQGS-GDF15 in the instant disclosure refers to a fusion protein comprising a GDF15 polypeptide linked to an HSA polypeptide via a linker comprising the sequence of SEQ ID NO:119 that connects the N-terminus of the GDF15 polypeptide to the C-terminus of the HSA polypeptide.

In certain embodiments, a homodimer is provided comprising two HSA-GSAAQAAQQGS-GDF15 fusion proteins, linked via an interchain disulfide bond between their respective GDF15 regions.

More particularly, in a specific embodiment, the homodimer comprises:

(a) two HSA polypeptides (one each monomer) comprising the sequence of SEQ ID NO:110;

(b) two GDF15 polypeptides (one each monomer) comprising the sequence of SEQ ID NO:12; and (c) two polypeptide linkers (one each monomer) comprising the sequence:
GSAAQAAQQGS (SEQ ID NO:119)
each linking the N-terminus of the GDF15 polypeptide to the C-terminus of an HSA polypeptide via a peptide bond.

In a preferred embodiment, the fusion protein comprises the amino acid sequence (linker double underlined):

(SEQ ID NO: 121)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL<u>GSAAQAAQQGS</u>ARNG

DHCPLGPGRCCRLHTVRASLEDLGWADWVLSPREVQVTMCIGACPSQFRA

ANMHAQIKTSLHRLKPDTVPAPCCVPASYNPMVLIQKTDTGVSLQTYDDL

LAKDCHCI, which is encoded by the nucleic acid sequence:

(SEQ ID NO: 120)
```
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag accagaggttgatgtgatgtgcactgcttttcatgacaatgaagagacat ttttgaaaaaatacttatatgaaattgccagaagacatccttacttttat gccccggaactccttttctttgctaaaaggtataaagctgcttttacaga atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt
```

-continued
```
tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct gacttgccttcattagctgctgattttgttgaaagtaaggatgtttgcaa aaactatgctgaggcaaaggatgtcttcctgggcatgttttgtatgaat atgcaagaaggcatcctgattactctgtcgtgctgctgctgagacttgcc aagacatatgaaaccactctagagaagtgctgtgccgctgcagatcctca tgaatgctatgccaaagtgttcgatgaatttaaacctcttgtggaagagc ctcagaatttaatcaaacaaaattgtgagcttttgagcagcttggagag tacaaattccagaatgcgctattagttcgttacaccaagaaagtaccca agtgtcaactccaactcttgtagaggtctcaagaaacctaggaaaagtgg gcagcaaatgttgtaaacatcctgaagcaaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg ctttgccgaggagggtaaaaaacttgttgcggccagtcaggccgcctag gcttaggatccgccgctcaggctgcacagcaaggaagcgcgcgcaacgga gaccactgtccgctcgggcccgggcgttgctgccgtctgcacacggtccg cgcgtcgctggaagacctgggctgggccgattgggtgctgtcgccacggg aggtgcaagtgaccatgtgcatcggcgcgtgcccgagccagttccgggcg gcaaacatgcacgcgcagatcaagacgagcctgcaccgcctgaagcccga cacggtgccagcgcctgctgcgtgcccgccagctacaatcccatggtgc tcattcaaaagaccgacaccggggtgtcgctccagacctatgatgacttg ttagccaaagactgccactgcatatga.
```

As discussed above, in a specific embodiment, a homodimer is provided comprising two fusion proteins having the sequence of SEQ ID NO:121.

II.G.6 HSA-GS(AAQAAQQ)₂GS-GDF15

The designation "HSA-GS(AAQAAQQ)₂GS-GDF15" in the instant disclosure refers to a fusion protein comprising a GDF15 polypeptide linked to an HSA polypeptide via a linker comprising the sequence of SEQ ID NO:122 that connects the N-terminus of the GDF15 polypeptide to the C-terminus of the HSA polypeptide.

In certain embodiments, a homodimer is provided comprising two HSA-GS(AAQAAQQ)₂GS-GDF15 fusion proteins, linked via an interchain disulfide bond between their respective GDF15 regions.

More particularly, in a specific embodiment, the homodimer comprises:
(a) two HSA polypeptides (one each monomer) comprising the sequence of SEQ ID NO:110;
(b) two GDF15 polypeptides (one each monomer) comprising the sequence of SEQ ID NO:12; and
(c) two polypeptide linkers (one each monomer) comprising the sequence:
GSAAQAAQQAAQAAQQGS (SEQ ID NO:122)
each linking the N-terminus of the GDF-15 polypeptide to the C-terminus of the HSA polypeptide via a peptide bond.

In a preferred embodiment, the fusion protein comprises the amino acid sequence (linker double underlined):

```
                                          (SEQ ID NO: 124)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGLGSAAQAAQQAAQAAQ

QGSARNGDHCPLGPGRCCRLHTVRASLEDLGWADWVLSPREVQVTMCIGA

CPSQFRAANMHAQIKTSLHRLKPDTVPAPCCVPASYNPMVLIQKTDTGVS

LQTYDDLLAKDCHCI,
``` which is encoded by the nucleic acid sequence:

```
                                          (SEQ ID NO: 123)
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctccccgattggtgag accagaggttgatgtgatgtgcactgcttttcatgacaatgaagagacat ttttgaaaaaatacttatatgaaattgccagaagacatccttactttat gccccggaactcctttctttgctaaaaggtataaagctgcttttacaga atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct
```

```
gacttgccttcattagctgctgattttgttgaaagtaaggatgtttgcaa aaactatgctgaggcaaaggatgtcttcctgggcatgttttgtatgaat atgcaagaaggcatcctgattactctgtcgtgctgctgctgagacttgcc aagacatatgaaaccactctagagaagtgctgtgccgctgcagatcctca tgaatgctatgccaaagtgttcgatgaatttaaacctcttgtggaagagc ctcagaatttaatcaaacaaaattgtgagcttttgagcagcttggagag tacaaattccagaatgcgctattagttcgttacaccaagaaagtacccca agtgtcaactccaactcttgtagaggtctcaagaaacctaggaaaagtgg gcagcaaatgttgtaaacatcctgaagcaaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg ctttgccgaggagggtaaaaaacttgttgcggccagtcaggccgcctag gcttaggatccgccgctcaggctgcacagcaagcagcccaagcagctcag cagggaagcgcgcgcaacggagaccactgtccgctcgggccgggcgttg ctgccgtctgcacacggtccgcgcgtcgctggaagacctgggctgggccg attgggtgctgtcgccacgggaggtgcaagtgaccatgtgcatcggcgcg tgcccgagccagttccgggcggcaaacatgcacgcgcagatcaagacgag cctgcaccgcctgaagcccgacacggtgccagcgccctgctgcgtgcccg ccagctacaatcccatggtgctcattcaaaagaccgacaccggggtgtcg ctccagacctatgatgacttgttagccaaagactgccactgcatatga.
```

As discussed above, in a specific embodiment, a homodimer is provided comprising two fusion proteins having the sequence of SEQ ID NO:124.

II.G.7 HSA-GGNAEAAAKEAAAKEAAAKAGG-GDF15

The designation "HSA-GGNAE-AAAKEAAAKEAAAKAGG-GDF15" in the instant disclosure refers to a fusion protein comprising a GDF15 polypeptide linked to an HSA polypeptide via a linker comprising the sequence of SEQ ID NO:125 that connects the N-terminus of the GDF15 polypeptide to the C-terminus of the HSA polypeptide.

In certain embodiments, a homodimer is provided comprising two HSA-GGNAEAAAKEAAAKEAAAKAGG-GDF 15 fusion proteins, linked via an interchain disulfide bond between their respective GDF15 regions.

More particularly, in a specific embodiment, the homodimer comprises:
(a) two HSA polypeptides (one each monomer) comprising the sequence of SEQ ID NO:110;
(b) two GDF15 polypeptides (one each monomer) comprising the sequence of SEQ ID NO:12; and
(c) two polypeptide linkers (one each monomer) comprising the sequence:
GGNAEAAAKEAAAKEAAAKAGG (SEQ ID NO:125)
each linking the N-terminus of the GDF-15 polypeptide to the C-terminus of the HSA polypeptide via a peptide bond.

In a preferred embodiment, the fusion protein comprises the amino acid sequence (linker double underlined):

(SEQ ID NO: 127)
DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGL<u>GGNAEAAAKEAAAKE</u>

<u>AAAKEAAAKAGG</u>ARNGDHCPLGPGRCCRLHTVRASLEDLGWADWVLSPRE

VQVTMCIGACPSQFRAANMHAQIKTSLHRLKPDTVPAPCCVPASYNPMVL

IQKTDTGVSLQTYDDLLAKDCHCI, which is encoded by the nucleic acid sequence:

(SEQ ID NO: 126)
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca taccctttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag accagaggttgatgtgatgtgcactgcttttcatgacaatgaagagacat ttttgaaaaaatacttatatgaaattgccagaagacatccttactttat gccccggaactccttttcttttgctaaaaggtataaagctgcttttacaga atgttgccaagctgctgataaagctgcctgcctgttgccaaagctcgatg aacttcgggatgaaggggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct gacttgccttcattagctgctgattttgttgaaagtaaggatgtttgcaa aaactatgctgaggcaaaggatgtcttcctgggcatgttttgtatgaat atgcaagaaggcatcctgattactctgtcgtgctgctgctgagacttgcc
```

-continued
aagacatatgaaaccactctagagaagtgctgtgccgctgcagatcctca tgaatgctatgccaaagtgttcgatgaatttaaacctcttgtggaagagc ctcagaatttaatcaaacaaaattgtgagcttttgagcagcttggagag tacaaattccagaatgcgctattagttcgttacaccaagaaagtacccca agtgtcaactccaactcttgtagaggtctcaagaaacctaggaaagtgg gcagcaaatgttgtaaacatcctgaagcaaaaagaatgccctgtgcagaa gactatctatccgtggtcctgaaccagttatgtgtgttgcatgagaaaac gccagtaagtgacagagtcaccaaatgctgcacagaatccttggtgaaca ggcgaccatgcttttcagctctggaagtcgatgaaacatacgttcccaaa gagtttaatgctgaaacattcaccttccatgcagatatatgcacactttc tgagaaggagagacaaatcaagaaacaaactgcacttgttgagctcgtga aacacaagcccaaggcaacaaaagagcaactgaaagctgttatggatgat ttcgcagcttttgtagagaagtgctgcaaggctgacgataaggagacctg ctttgccgaggagggtaaaaaacttgttgcggccagtcaggccgcttag gcttaggaggcaacgccgaggctgccgctaaggaagccgctgccaaggag gccgcagcaaaagaggctgcagctaaggccggaggagcgcgcaacggaga ccactgtccgctcgggcccgggcgttgctgccgtctgcacacggtccgcg cgtcgctggaagacctgggctgggccgattgggtgctgtcgccacgggag gtgcaagtgaccatgtgcatcggcgcgtgcccgagccagttccgggcggc aaacatgcacgcgcagatcaagacgagcctgcaccgcctgaagcccgaca cggtgccagcgccctgctgcgtgcccgccagctacaatcccatggtgctc attcaaaagaccgacaccggggtgtcgctccagacctatgatgacttgtt agccaaagactgccactgcatatga.

As discussed above, in a specific embodiment, a homodimer is provided comprising two fusion proteins having the sequence of SEQ ID NO:127.

II.G.8 HSA-(G₄S)₆-GDF15

The designation "HSA-(G₄S)₆-GDF15" in the instant disclosure refers to a fusion protein comprising a GDF15 polypeptide linked to an HSA polypeptide via a linker comprising the sequence of SEQ ID NO:128 that connects the N-terminus of the GDF15 polypeptide to the C-terminus of the HSA polypeptide.

In certain embodiments, a homodimer is provided comprising two HSA-(G₄S)₆-GDF15 fusion proteins, linked via an interchain disulfide bond between their respective GDF15 regions.

More particularly, in a specific embodiment, the homodimer comprises:

(a) two HSA polypeptides (one each monomer) comprising the sequence of SEQ ID NO:110;

(b) two GDF15 polypeptides (one each monomer) comprising the sequence of SEQ ID NO:12; and (c) two polypeptide linkers (one each monomer) comprising the sequence:
GGGGSGGGGSGGGGSGGGGSGGGGSGGGGS (SEQ ID NO:128)
each linking the N-terminus of the GDF-15 polypeptide to the C-terminus of the HSA polypeptide via a peptide bond.

In a preferred embodiment, the fusion protein comprises the amino acid sequence (linker double underlined):

(SEQ ID NO: 130)
DAHKSEVAHRFKDLGEENFKALVLIAFAQYLQQCPFEDHVKLVNEVTEFA

DAHKSEVAHRFKDLGEENFKALVLIAFAQYLQQCPFEDHVKLVNEVTEFA

KTCVADESAENCDKSLHTLFGDKLCTVATLRETYGEMADCCAKQEPERNE

CFLQHKDDNPNLPRLVRPEVDVMCTAFHDNEETFLKKYLYEIARRHPYFY

APELLFFAKRYKAAFTECCQAADKAACLLPKLDELRDEGKASSAKQRLKC

ASLQKFGERAFKAWAVARLSQRFPKAEFAEVSKLVTDLTKVHTECCHGDL

LECADDRADLAKYICENQDSISSKLKECCEKPLLEKSHCIAEVENDEMPA

DLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGE

YKFQNALLVRYTKKVPQVSTPTLVEVSRNLGKVGSKCCKHPEAKRMPCAE

DYLSVVLNQLCVLHEKTPVSDRVTKCCTESLVNRRPCFSALEVDETYVPK

EFNAETFTFHADICTLSEKERQIKKQTALVELVKHKPKATKEQLKAVMDD

FAAFVEKCCKADDKETCFAEEGKKLVAASQAALGLGGGGSGGGGSGGGGS

GGGGSGGGGSGGGGSARNGDHCPLGPGRCCRLHTVRASLEDLGWADWVLS

PREVQVTMCIGACPSQFRAANMHAQIKTSLHRLKPDTVPAPCCVPASYNP

MVLIQKTDTGVSLQTYDDLLAKDCHCI, which is encoded by the nucleic acid sequence:

(SEQ ID NO: 129)
gatgcacacaagagtgaggttgctcatcgatttaaagatttgggagaaga aaatttcaaagccttggtgttgattgcctttgctcagtatcttcagcagt gtccatttgaagatcatgtaaaattagtgaatgaagtaactgaatttgca aaaacatgtgttgctgatgagtcagctgaaaattgtgacaaatcacttca tacccttttggagacaaattatgcacagttgcaactcttcgtgaaacct atggtgaaatggctgactgctgtgcaaaacaagaacctgagagaaatgaa tgcttcttgcaacacaaagatgacaacccaaacctcccccgattggtgag accagaggttgatgtgatgtgcactgcttttcatgacaatgaagagacat ttttgaaaaaatacttatatgaaattgccagaagacatccttacttttat gccccggaactccttttctttgctaaaaggtataaagctgcttttacaga atgttgccaagctgctgataaagctgcctgcctgttgccaaagctcgatg aacttcgggatgaagggaaggcttcgtctgccaaacagagactcaagtgt gccagtctccaaaaatttggagaaagagctttcaaagcatgggcagtagc tcgcctgagccagagatttcccaaagctgagtttgcagaagtttccaagt tagtgacagatcttaccaaagtccacacggaatgctgccatggagatctg cttgaatgtgctgatgacagggcggaccttgccaagtatatctgtgaaaa tcaagattcgatctccagtaaactgaaggaatgctgtgaaaaacctctgt tggaaaaatcccactgcattgccgaagtggaaaatgatgagatgcctgct gacttgcctcattagctgctgatttgttgaaagtaaggatgtttgcaa aaactatgctgaggcaaaggatgtcttcctgggcatgtttttgtatgaat atgcaagaaggcatcctgattactctgtcgtgctgctgctgagacttgcc aagacatatgaaaccactctagagaagtgctgtgccgctgcagatcctca -continued

```
tgaatgctatgccaaagtgttcgatgaatttaaacctcttgtggaagagc
ctcagaatttaatcaaacaaaattgtgagcttttgagcagcttggagag
tacaaattccagaatgcgctattagttcgttacaccaagaaagtacccca
agtgtcaactccaactcttgtagaggtctcaagaaacctaggaaaagtgg
gcagcaaatgttgtaaacatcctgaagcaaaagaatgccctgtgcagaa
gactatctatccgtggtcctgaaccagttatgtgtgttgcatgagaaaac
gccagtaagtgacagagtcaccaaatgctgcacagaatccttggtgaaca
ggcgaccatgcttttcagctctggaagtcgatgaaacatacgttcccaaa
gagtttaatgctgaaacattcaccttccatgcagatatatgcacactttc
tgagaaggagagacaaatcaagaaacaaactgcacttgttgagctcgtga
aacacaagcccaaggcaacaaaagagcaactgaaagctgttatggatgat
ttcgcagcttttgtagagaagtgctgcaaggctgacgataaggagacctg
ctttgccgaggagggtaaaaaacttgttgcggccagtcaggccgcttag
gcttaggaggtggtggctctggaggcggtggaagcggaggcggtggatcc
ggaggcggtggaagcggaggtggtggatctggaggcggtggaagcgcgcg
caacggagaccactgtccgctcggcccgggcgttgctgccgtctgcaca
cggtccgcgcgtcgctggaagacctgggctgggccgattgggtgctgtcg
ccacgggaggtgcaagtgaccatgtgcatcggcgcgtgcccgagccagtt
ccgggcggcaaacatgcacgcgcagatcaagacgagcctgcaccgcctga
agcccgacacggtgccagcgccctgctgcgtgcccgccagctacaatccc
atggtgctcattcaaaagaccgacaccggggtgtcgctccagacctatga
tgacttgttagccaaagactgccactgcatatga.
```

As discussed above, in a specific embodiment, a homodimer is provided comprising two fusion proteins having the sequence of SEQ ID NO:130.

II.G.9 HSA-GS(AAQAAQQ)₂GS-GDF15(N3D)

The designation "HSA-GS(AAQAAQQ)₂GS-GDF15(N3D)" in the instant disclosure refers to a fusion protein comprising a GDF15(N3D) polypeptide linked to an HSA polypeptide via a linker comprising the sequence of SEQ ID NO:122 that connects the N-terminus of the GDF15(N3D) polypeptide to the C-terminus of the HSA polypeptide.

In certain embodiments, a homodimer is provided comprising two HSA-GS(AAQAAQQ)₂GS-GDF15(N3D) fusion proteins, linked via an interchain disulfide bond between their respective GDF15 regions.

More particularly, in a specific embodiment, the homodimer comprises:

(a) two HSA polypeptides (one each monomer) comprising the sequence of SEQ ID NO:110;

(b) two GDF15(N3D) polypeptides (one each monomer) comprising the sequence of SEQ ID NO:52; and (c) two polypeptide linkers (one each monomer) comprising the sequence of SEQ ID NO:122 each linking the N-terminus of a GDF15(N3D) polypeptide to the C-terminus of an HSA polypeptide via a peptide bond.

In a preferred embodiment, the fusion protein comprises the amino acid sequence (linker double underlined):

(SEQ ID NO: 242)
DAHKSEVAHRFKDLGEENFKALVLIAFAQYLQQCPFEDHVKLVNEVTEFA
KTCVADESAENCDKSLHTLFGDKLCTVATLRETYGEMADCCAKQEPERNE
CFLQHKDDNPNLPRLVRPEVDVMCTAFHDNEETFLKKYLYEIARRHPYFY
APELLFFAKRYKAAFTECCQAADKAACLLPKLDELRDEGKASSAKQRLKC
ASLQKFGERAFKAWAVARLSQRFPKAEFAEVSKLVTDLTKVHTECCHGDL
LECADDRADLAKYICENQDSISSKLKECCEKPLLEKSHCIAEVENDEMPA
DLPSLAADFVESKDVCKNYAEAKDVFLGMFLYEYARRHPDYSVVLLLRLA
KTYETTLEKCCAAADPHECYAKVFDEFKPLVEEPQNLIKQNCELFEQLGE
YKFQNALLVRYTKKVPQVSTPTLVEVSRNLGKVGSKCCKHPEAKRMPCAE
DYLSVVLNQLCVLHEKTPVSDRVTKCCTESLVNRRPCFSALEVDETYVPK
EFNAETFTFHADICTLSEKERQIKKQTALVELVKHKPKATKEQLKAVMDD
FAAFVEKCCKADDKETCFAEEGKKLVAASQAALG<u>GSAAQAAQQAAQAAQ</u>
<u>QGS</u>ARDGDHCPLGPGRCCRLHTVRASLEDLGWADWVLSPREVQVTMCIGA
CPSQFRAANMHAQIKTSLHRLKPDTVPAPCCVPASYNPMVLIQKTDTGVS
LQTYDDLLAKDCHCI, which is encoded by the nucleic acid sequence:

(SEQ ID NO: 241)
```
gatgcacacaagagtgaggttgctcatcgatttaaagatttgg
gagaagaaaatttcaaagccttggtgttgattgcctttgctcagtatctt
cagcagtgtccatttgaagatcatgtaaaattagtgaatgaagtaactga
atttgcaaaaacatgtgttgctgatgagtcagctgaaaattgtgacaaat
cacttcatacccttttggagacaaattatgcacagttgcaactcttcgt
gaaacctatggtgaaatggctgactgctgtgcaaaacaagaacctgagag
aaatgaatgcttcttgcaacacaaagatgacaacccaaacctcccccgat
tggtgagaccagaggttgatgtgatgtgcactgcttttcatgacaatgaa
gagacattttgaaaaaatacttatatgaaattgccagaagacatcctta
cttttatgccccggaactccttttctttgctaaaaggtataaagctgctt
ttacagaatgttgccaagctgctgataaagctgcctgcctgttgccaaag
ctcgatgaacttcgggatgaagggaaggcttcgtctgccaaacagagact
caagtgtgccagtctccaaaaatttggagaaagagctttcaaagcatggg
cagtagctcgcctgagccagagatttcccaaagctgagtttgcagaagtt
tccaagttagtgacagatcttaccaaagtccacacggaatgctgccatgg
agatctgcttgaatgtgctgatgacagggcggaccttgccaagtatatct
gtgaaaatcaagattcgatctccagtaaactgaaggaatgctgtgaaaaa
cctctgttggaaaaatcccactgcattgccgaagtggaaaatgatgagat
gcctgctgacttgccttcattagctgctgattttgttgaaagtaaggatg
tttgcaaaaactatgctgaggcaaaggatgtcttcctgggcatgttttg
tatgaatatgcaagaaggcatcctgattactctgtcgtgctgctgctgag
acttgccaagacatatgaaaccactctagagaagtgctgtgccgctgcag
atcctcatgaatgctatgccaaagtgttcgatgaatttaaacctcttgtg
```

-continued
gaagagcctcagaatttaatcaaacaaaattgtgagcttttttgagcagct tggagagtacaaattccagaatgcgctattagttcgttacaccaagaaag taccccaagtgtcaactccaactcttgtagaggtctcaagaaacctagga aaagtgggcagcaaatgttgtaaacatcctgaagcaaaaagaatgccctg tgcagaagactatctatccgtggtcctgaaccagttatgtgtgttgcatg agaaaacgccagtaagtgacagagtcaccaaatgctgcacagaatccttg gtgaacaggcgaccatgcttttcagctctggaagtcgatgaaacatacgt tcccaaagagtttaatgctgaaacattcaccttccatgcagatatatgca cactttctgagaaggagagacaaatcaagaaacaaactgcacttgttgag ctcgtgaaacacaagcccaaggcaacaaaagagcaactgaaagctgttat ggatgatttcgcagcttttgtagagaagtgctgcaaggctgacgataagg agacctgctttgccgaggagggtaaaaaacttgttgcggccagtcaggcc gccttaggcttaggatccgccgctcaggctgcacagcaagcagcccaagc agctcagcagggaagcgcgcgcgacggagaccactgtccgctcgggcccg ggcgttgctgccgtctgcacacggtccgcgcgtcgctggaagacctgggc tgggccgattgggtgctgtcgccacgggaggtgcaagtgaccatgtgcat cggcgcgtgcccgagccagttccgggcggcaaacatgcacgcgcagatca agacgagcctgcaccgcctgaagcccgacacggtgccagcgcctgctgc gtgcccgccagctacaatcccatggtgctcattcaaaagaccgacaccgg ggtgtcgctccagacctatgatgacttgttagccaaagactgccactgca ta.

As discussed above, in a specific embodiment, a homodimer is provided comprising two fusion proteins having the sequence of SEQ ID NO:242.

II.H. Constructs with Mutations to Address Affinity for FcγR Binding

It was found that certain charged pair (delHinge) multimers exhibited Fcγ receptor (FcγR) binding, particularly to FcγRI and FcγRIII. See, e.g., Example 7. In some cases, the FcγR binding affinity was comparable to that of observed in multimers comprising a hinge region. This was unexpected, because the Fcγ receptor interacts with the hinge region and these multimers were delHinge, as described above, lacking all or part of the hinge region. Mutational analyses of the Fc residues involved in binding to FcγR suggest that the main interaction site is localized in the hinge region and CH2 domain (Tamm A, 1997, *Int. Rev. Immunol.* 16:57-85). See also, Radaev S, et al., *J. Biol. Chem.* 276:16469-16477; Sondermann, P, et al., 2000, *Nature* 406:267-273.

Antibody-dependent cellular cytotoxicity (ADCC), an immune response mediated primarily by natural killer (NK) cells in humans, depends on the interaction of FcγRs, especially FcγRIIIA in humans, with the Fc domain of an antibody or Fc-containing protein. In ADCC, Fc binding to FcγRIII on the surface of an NK cell activates the NK cell, which releases perforins and granzymes.

Accordingly, constructs are provided having additional modifications to modulate the interaction of the construct with the FcγR. In one series of embodiments, an asparagine to glycine mutation (N297G) is introduced to a native Fc or Fc variant, including the various Fc domains described above. The N297G mutation removes a conserved N-glycosylation site at in the CH2 domain.

In another series of embodiments, additional N-terminal amino acid residues are deleted from an Fc domain from which all or a portion of the hinge region has been removed. For example, the amino acid sequence:

(SEQ ID NO: 303)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSREEMTKNQVSLTCLVKGFYPSDIAVEWESNG

QPENNYKTTPPVLDSDGSFFLYSKLTVDKSRWQQGNVFSCSVMHEALHNH

YTQKSLSLSPGK is provided by deletion of amino acid residues N-terminal to G236 of the Fc domain of wild-type IgG1. In some embodiments, the C-terminal lysine (K447) optionally may be deleted from this Fc variant. The amino acid sequence:

(SEQ ID NO: 304)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQ

PENNYKTTPPVLDSDGSFFLYSKLTVDKSRWQQGNVFSCSVMHEALHNHY

TQKSLSLSPGK is provided by deletion of amino acid residues N-terminal to G237 from the Fc domain of wild-type IgG1. In some embodiments, the C-terminal lysine (K447) optionally may be deleted from this Fc variant. The amino acid sequence:

(SEQ ID NO: 305)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYKTTPPVLDSDGSFFLYSKLTVDKSRWQQGNVFSCSVMHEALHNHYT

QKSLSLSPGK is provided by deletion of amino acid residues N-terminal to P238 of the Fc domain of wild-type IgG1. In some embodiments, the C-terminal lysine (K447) optionally may be deleted from this Fc variant.

In one embodiment, a DhCpmFc(−) domain into which an asparagine to glycine mutation (N297G) has been introduced is provided (referred to herein as a "DhCpmFc(−)(N297G)" domain). In another embodiment, a DhCpmFc(+) domain into which an asparagine to glycine mutation (N297G) has been introduced is provided (referred to herein as a "DhCpmFc(+)(N297G)" domain).

In another embodiment, a DhCpmFc(−)(Y349C) domain into which an asparagine to glycine mutation (N297G) has been introduced is provided (referred to herein as a "DhCpmFc(−)(N297G)(Y349C)" domain). In another embodiment, a DhCpmFc(+)(S354C) domain into which an asparagine to glycine mutation (N297G) has been introduced is provided (referred to herein as a "DhCpmFc(+)(N297G)(S354C)" domain).

In another embodiment, a DhCpmFc(+)(Y349C) domain into which an asparagine to glycine mutation (N297G) has been introduced is provided (referred to herein as a "DhCpmFc(+)(N297G)(Y349C)" domain). In another embodiment, a DhCpmFc(−)(S354C) domain into which an asparagine to glycine mutation (N297G) has been introduced is provided (referred to herein as "DhCpmFc(−)(N297G)(S354C)" domain).

In another embodiment, a DhCpmFc(+)(L351C) domain into which an asparagine to glycine mutation (N297G) has been introduced is provided (referred to herein as a "DhCpmFc(+)(N297G)(L351C)" domain). In another embodiment, a DhCpmFc(−)(L351C) domain into which an asparagine to glycine mutation (N297G) has been introduced is provided (referred to herein as a "DhCpmFc(−)(N297G)(L351C)" domain).

In another embodiment, a DhCpmFc(−) domain into which an alanine to cysteine mutation (A287C) has been introduced is provided (referred to herein as a "DhCpmFc(−)(A287C)" domain). In another embodiment, a DhCpmFc(+) domain into which an alanine to cysteine mutation (A287C) has been introduced is provided (referred to herein as a "DhCpmFc(+)(A287C)" domain).

In another embodiment, a DhCpmFc(−) domain into which a leucine to cysteine mutation (L306C) has been introduced is provided (referred to herein as a "DhCpmFc(−)(L306C)" domain). In another embodiment, a DhCpmFc(+) domain into which a leucine to cysteine mutation (L306C) has been introduced is provided (referred to herein as a "DhCpmFc(+)(L306C)" domain).

In another embodiment, a DhCpmFc(−)(A287C) domain into which a tyrosine to cysteine mutation (Y349C) has been introduced is provided (referred to herein as a "DhCpmFc(−)(A287C)(Y349C)" domain). In another embodiment, a DhCpmFc(+)(A287C) domain into which a tyrosine to cysteine mutation (Y349C) has been introduced is provided (referred to herein as a "DhCpmFc(+)(A287C)(Y349C)" domain).

In another embodiment, a DhCpmFc(−)(A287C) domain into which a serine to cysteine mutation (S354C) has been introduced is provided (referred to herein as a "DhCpmFc(−)(A287C)(S354C)" domain). In another embodiment, a DhCpmFc(+)(A287C) domain into which a serine to cysteine mutation (S354C) has been introduced is provided (referred to herein as a "DhCpmFc(+)(A287C)(S354C)" domain).

In another embodiment, a DhCpmFc(−)(L306C) domain into which a tyrosine to cysteine mutation (Y349C) has been introduced is provided (referred to herein as a "DhCpmFc(−)(L306C)(Y349C)" domain). In another embodiment, a DhCpmFc(+)(L306C) domain into which a tyrosine to cysteine mutation (Y349C) has been introduced is provided (referred to herein as a "DhCpmFc(+)(L306C)(Y349C)" domain).

In another embodiment, a DhCpmFc(−)(L306C) domain into which a serine to cysteine mutation (S354C) has been introduced is provided (referred to herein as a "DhCpmFc(−)(L306C)(S354C)" domain). In another embodiment, a DhCpmFc(+)(L306C) domain into which a serine to cysteine mutation (S354C) has been introduced is provided (referred to herein as a "DhCpmFc(+)(A287C)(L306C)" domain).

In another embodiment, a DhCpmFc(−) domain from which the N-terminal 7 amino acids have been removed is provided (referred to herein as a "Dh2CpmFc(−)" domain). In another embodiment, a DhCpmFc(+) domain from which the N-terminal 7 amino acids have been removed is provided (referred to herein as a "Dh2CpmFc(+)" domain).

In another embodiment, a DhCpmFc(−)(Y349C) domain from which the N-terminal 7 amino acids have been removed is provided (referred to herein as a "Dh2CpmFc(−)(Y349C)" domain). In another embodiment, a DhCpmFc(+)(S354C) domain from which the N-terminal 7 amino acids have been removed is provided (referred to herein as a "Dh2CpmFc(+)(S354C)" domain).

In another embodiment, a DhCpmFc(+)(Y349C) domain from which the N-terminal 7 amino acids have been removed is provided (referred to herein as a "Dh2CpmFc(+)(Y349C)" domain). In another embodiment, a DhCpmFc(−)(S354C) domain from which the N-terminal 7 amino acids have been removed is provided (referred to herein as a "Dh2CpmFc(−) (S354C)" domain).

In another embodiment, a CpmFc(+) domain into which an asparagine to glycine mutation (N297G) has been introduced is provided (referred to herein as a "CpmFc(+)(N297G)" domain). In another embodiment, a CpmFc(−) domain into which an asparagine to glycine mutation (N297G) has been introduced is provided (referred to herein as a "CpmFc(−)(N297G)" domain).

In another embodiment, a Dh2CpmFc(+) domain into which an asparagine to glycine mutation (N297G) has been introduced is provided (referred to herein as a "Dh2CpmFc(+)(N297G)" domain). In another embodiment, a Dh2CpmFc(−) domain into which an asparagine to glycine mutation (N297G) has been introduced is provided (referred to herein as a "Dh2CpmFc(−)(N297G)" domain).

In another embodiment, a Dh2CpmFc(−)(N297G) domain into which an alanine to cysteine mutation (A287C) has been introduced is provided (referred to herein as a "Dh2CpmFc(−)(N297G)(A287C)" domain). In another embodiment, Dh2CpmFc(+)(N297G) domain into which a leucine to cysteine mutation (L306C) has been introduced is provided (referred to herein as a "Dh2CpmFc(+)(N297G)(L306C)" domain).

In another embodiment, a Dh2CpmFc(−)(N297G)(A287C) domain into which a tyrosine to cysteine mutation (Y349C) has been introduced is provided (referred to herein as a "Dh2CpmFc(−)(N297G)(A287C)(Y349C)" domain). In another embodiment, a Dh2CpmFc(+)(N297G)(L306C) domain into which a serine to cysteine mutation (S354C) has been introduced is provided (referred to herein as a "Dh2CpmFc(+)(N297G)(L306C)(S354C)" domain).

In another embodiment, a Dh2CpmFc(−) domain onto which two glycines have been added to the N-terminus is provided (referred to herein as a "GG-Dh2CpmFc(−)(N297G)" domain). In another embodiment, a Dh2CpmFc(+) domain onto which two glycines have been added to the N-terminus is provided (referred to herein as a "GG-Dh2CpmFc(+)(N297G)" domain).

In another embodiment, a GG-Dh2CpmFc(−) domain into which a tyrosine to cysteine mutation (Y349C) have been introduced is provided (referred to herein as a "GG-Dh2CpmFc(−)(Y349C)" domain). In another embodiment, a GG-Dh2CpmFc(+) domain into which a serine to cysteine mutation (S354C) has been introduced is provided (referred to herein as a "GG-Dh2CpmFc(+)(S354C)" domain).

In another embodiment, a GG-Dh2CpmFc(+) domain into which a tyrosine to cysteine mutation (Y349C) has been introduced is provided (referred to herein as a "GG-Dh2CpmFc(+)(Y349C)" domain). In another embodiment, a GG-Dh2CpmFc(−) domain into which a serine to cysteine mutation (S354C) has been introduced is provided (referred to herein as a "GG-Dh2CpmFc(−)(S354C)" domain).

In another embodiment, a Dh2CpmFc(−) domain onto which a glycine has been added to the N-terminus is provided (referred to herein as a "Dh3CpmFc(−)(N297G)" domain). In another embodiment, a Dh2CpmFc(+) domain onto which a glycine has been added to the N-terminus is provided (referred to herein as a "Dh3CpmFc(+)" domain).

In another embodiment, a Dh3CpmFc(−) domain into which a tyrosine to cysteine mutation (Y349C) has been introduced is provided (referred to herein as a "Dh3CpmFc(−)(Y349C)" domain). In another embodiment, a Dh3CpmFc(+) domain into which a serine to cysteine mutation (S354C) has been introduced is provided (referred to herein as a "Dh3CpmFc(+)(S354C)" domain).

In another embodiment, an asparagine to glycine mutation (N297G) is introduced into a DhMonoFc domain (referred to herein as "DhMonoFc(N297G)").

II.H.1 DhCpmFc(−)(N297G)-GDF15(Ndel3):DhCpmFc(+)(N297G)

The designation "DhCpmFc(−)(N297G)-GDF15(Ndel3): DhCpmFc(+)(N297G)" in the instant disclosure refers to a heterodimer comprising (i) a first polypeptide chain comprising a GDF15(Ndel3) polypeptide, the N-terminus of which is linked directly to the C-terminus of a DhCpmFc(−)(N297G) domain, and (ii) a second polypeptide chain comprising a DhCpmFc(+)(N297G) domain.

In certain embodiments, a tetramer is provided, comprising a dimer of two DhCpmFc(−)(N297G)-GDF15(Ndel3): DhCpmFc(+)(N297G) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G) domains (one each heterodimer) comprising the sequence:

(SEQ ID NO: 287)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG, (b) two DhCpmFc(−)(N297G) domains (one each heterodimer) comprising the sequence:

(SEQ ID NO: 132)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 134)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGDHCPLGPGRCCRLHTVRASLEDLGWADWVLSPR

EVQVTMCIGACPSQFRAANMHAQIKTSLHRLKPDTVPAPCCVPASYNPMV

LIQKTDTGVSLQTYDDLLAKDCHCI, which is encoded by the nucleic acid sequence:

(SEQ ID NO: 133)
gcacctgaactcctggggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacgg gagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggcccgggcgttgctgccgtctgcacacggtcc gcgcgtcgctggaagacctgggctgggccgattgggtgctgtcgccacgg gaggtgcaagtgaccatgtgcatcggcgcgtgcccgagccagttccgggc ggcaaacatgcacgcgcagatcaagacgagcctgcaccgcctgaagcccg acacggtgccagcgcctgctgcgtgcccgccagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence:

(SEQ ID NO: 131)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 135)
gcacctgaactcctggggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacgg

```
gagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccggaggagatgaccaagaaccaggtca gcctgacctgcctggtcaaaggcttctatcccagcgacatcgccgtggag tgggagagcaatgggcagccggagaacaactacaagaccacgcctcccgt gctgaagtccgacggctccttcttcctctatagcaagctcaccgtggaca agagcaggtggcagcaggggaacgtcttctcatgctccgtgatgcatgag gctctgcacaaccactacacgcagaagagcctctccctgtctccgggtaa atga.
```

As discussed above, a tetramer is provided comprising two polypeptide chains comprising the sequence of SEQ ID NO:134 and two polypeptide chains comprising the sequence of SEQ ID NO:131.

II.H.2 DhCpmFc(−)(N297G)-GDF15(N3D):DhCpmFc(+)(N297G)

The designation "DhCpmFc(−)(N297G)-GDF15(N3D): DhCpmFc(+)(N297G)" in the instant disclosure refers to a heterodimer comprising (i) a first polypeptide chain comprising a GDF15(N3D) sequence, the N-terminus of which is linked directly to the C-terminus of a DhCpmFc(−)(N297G) domain, and (ii) a second polypeptide chain comprising a DhCpmFc(+)(N297G) domain.

In certain embodiments, a tetramer is provided, comprising a dimer of two DhCpmFc(−)(N297G)-GDF15(N3D):DhCpmFc(+)(N297G) heterodimers in which the two first polypeptide chains of each heterodimer are linked via an interchain disulfide bond between their respective GDF15 regions.

More particularly, in a specific embodiment, the tetramer comprises:
(a) two DhCpmFc(+)(N297G) domains (one each heterodimer) comprising the sequence of SEQ ID NO:287,
(b) two DhCpmFc(−)(N297G) domains (one each heterodimer) comprising the sequence of SEQ ID NO:132, and
(c) two GDF15(N3D) polypeptides (one each heterodimer) comprising the sequence of SEQ ID NO:52.

In a preferred embodiment, the first polypeptide chain comprises the amino acid sequence:

(SEQ ID NO: 137)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

```
                                      (SEQ ID NO: 136)
gcacctgaactcctgggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacgg gagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.
```

In a preferred embodiment, the second polypeptide chain comprises the amino acid sequence of SEQ ID NO:131, which is encoded by the nucleic acid sequence of SEQ ID NO:135.

As discussed above, a tetramer is provided comprising two polypeptide chains comprising the sequence of SEQ ID NO:137 and two polypeptide chains comprising the sequence of SEQ ID NO:131.

II.H.3 DhCpmFc(−)(N297G)-G$_4$-GDF15(N3D):DhCpmFc(+)(N297G)

The designation "DhCpmFc(−)(N297G)-G$_4$-GDF15(N3D):DhCpmFc(+)(N297G)" in the instant disclosure refers to a heterodimer comprising (i) a first polypeptide chain comprising a GDF15(N3D) polypeptide linked to a DhCpmFc(−)(N297G) domain via a linker comprising the sequence of SEQ ID NO:58 that connects the N-terminus of the GDF15(N3D) polypeptide to the C-terminus of the DhCpmFc(−)(N297G) domain and (ii) a second polypeptide chain comprising a DhCpmFc(+)(N297G) domain.

In certain embodiments, a tetramer is provided, comprising a dimer of two DhCpmFc(−)(N297G)-G$_4$-GDF15(N3D):DhCpmFc(+)(N297G) heterodimers in which the two first polypeptide chains of each heterodimer are linked via an interchain disulfide bond between their respective GDF15 regions.

More particularly, in a specific embodiment, the tetramer comprises:
(a) two DhCpmFc(+)(N297G) domains (one each heterodimer) comprising the sequence of SEQ ID NO:287,
(b) two DhCpmFc(−)(N297G) domains (one each heterodimer) comprising the sequence of SEQ ID NO:132,
(c) two GDF15(N3D) polypeptides (one each heterodimer) comprising the sequence of SEQ ID NO:52, and
(d) two polypeptide linkers (one each heterodimer) comprising the sequence of SEQ ID NO:58 each linking the N-terminus of a GDF15(N3D) polypeptide to the C-terminus of a DhCpmFc(−)(N297G) domain via a peptide bond.

In a preferred embodiment, the first polypeptide chain comprises the amino acid sequence:

(SEQ ID NO: 139)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u>GGGG</u>ARDGDHCPLGPGRCCRLHTVRASLEDLGWA

DWVLSPREVQVTMCIGACPSQFRAANMHAQIKTSLHRLKPDTVPAPCCVP

ASYNPMVLIQKTDTGVSLQTYDDLLAKDCHCI, which is encoded by the nucleic acid sequence:

(SEQ ID NO: 138)
gcacctgaactcctgggggaccgtcagtcttcctcttcccccaaaacc caaggacaccctcatgatctcccgacccctgaggtcacatgcgtggtg tggacgtgagccacgaagaccctgaggtcaagttcaactggtacgtggac ggcgtggaggtgcataatgccaagacaaagccgcgggaggagcagtacgg gagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg aggtggtggagcgcgcgacggagaccactgtccgctcgggcccgggcgtt gctgccgtctgcacacggtccgcgcgtcgctggaagacctgggctgggcc gattgggtgctgtcgccacgggaggtgcaagtgaccatgtgcatcggcgc gtgcccgagccagttccgggcggcaaacatgcacgcgcagatcaagacga gcctgcaccgcctgaagcccgacacggtgccagcgccctgctgcgtgccc gccagctacaatcccatggtgctcattcaaaagaccgacaccggggtgtc gctccagacctatgatgacttgttagccaaagactgccactgcata.

In a preferred embodiment, the second polypeptide chain comprises the amino acid sequence of SEQ ID NO:131, which is encoded by the nucleic acid sequence of SEQ ID NO:135.

As discussed above, a tetramer is provided comprising two polypeptide chains comprising the sequence of SEQ ID NO:139 and two polypeptide chains comprising the sequence of SEQ ID NO:131.

II.H.4 DhCpmFc(−)(N297G)(Y349C)-GDF15(Ndel3):DhCpmFc(+)(N297G)(S354C)

The designation "DhCpmFc(−)(N297G)(Y349C)-GDF15(Ndel3):DhCpmFc(+)(N297G)(S354C)" in the instant disclosure refers to a heterodimer comprising (i) a first polypeptide chain comprising a GDF15(Ndel3) polypeptide, the N-terminus of which is linked directly to the C-terminus of a DhCpmFc(−)(N297G)(Y349C) domain, and (ii) a second polypeptide chain comprising a DhCpmFc(+)(N297G)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(N297G)(Y349C)-GDF15(Ndel3):DhCpmFc(+)(N297G)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(S354C) domains (one each heterodimer) comprising the sequence:

(SEQ ID NO: 288)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG, (b) two DhCpmFc(−)(N297G)(Y349C) domains (one each heterodimer) comprising the sequence:

(SEQ ID NO: 141)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 143)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGDHCPLGPGRCCRLHTVRASLEDLGWADWVLSPR

EVQVTMCIGACPSQFRAANMHAQIKTSLHRLKPDTVPAPCCVPASYNPMV

LIQKTDTGVSLQTYDDLLAKDCHCI, which is encoded by the nucleic acid sequence:

(SEQ ID NO: 142)
gcacctgaactcctgggggaccgtcagtcttcctcttcccccaaaacc caaggacaccctcatgatctcccggacccctgaggtcacatgcgtggtgg -continued
tggacgtgagccacgaagaccctgaggtcaagttcaactggtacgtggac ggcgtggaggtgcataatgccaagacaaagccgcgggaggagcagtacgg cagcacgtaccgtgtggtcagcgtcctcaccgtcctgcaccaggactggc tgaatggcaaggagtacaagtgcaaggtctccaacaaagccctcccagcc cccatcgagaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggcccgggcgttgctgccgtctgcacacggtcc gcgcgtcgctggaagacctgggctgggccgattgggtgctgtcgccacgg gaggtgcaagtgaccatgtgcatcggcgcgtgcccgagccagttccggc ggcaaacatgcacgcgcagatcaagacgagcctgcaccgcctgaagcccg acacggtgccagcgccctgctgcgtgcccgccagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence:

(SEQ ID NO: 140)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 144)
gccccagagctgcttggtggaccatccgtgttcctgtttcctccaaagcc gaaggacaccctgatgatctcaagaactccggaagtgacttgcgtcgtcg tggacgtgtcacatgaggatccagaggtcaagttcaattggtatgtggac ggagtggaagtgcataacgccaagaccaaacccgcgaagaacagtacgg gagcacctaccgcgtggtgagcgtccttactgtgctccaccaggactggc ttaatgggaaggaatacaagtgtaaggtgtccaacaaggccctcccgct cccatcgaaagaccatctcaaagccaaaggggcaaccaagggaacctca agtgtacaccctgcctccgtgcaggaaggagatgaccaagaaccaggtca gcctgacttgtctcgtgaagggcttctatcccagcgatattgctgtggaa tgggagtcaaatggccagcccgagaataactacaaaactaccccaccgt gctgaaatctgatgggtccttcttcctttactccaagctgaccgtggaca agagccgctggcaacaaggcaatgtctttagctgctcagtgatgcatgag gctctccataatcactacactcagaagtcactgtccctgtctccgggtaa a.

As discussed above, a tetramer is provided comprising two polypeptide chains comprising the sequence of SEQ ID NO:143 and two polypeptide chains comprising the sequence of SEQ ID NO:140.

II.H.5 DhCpmFc(−)(N297G)(Y349C)-GDF15(N3D):Dh-CpmFc(+)(N297G)(S354C)

The designation "DhCpmFc(−)(N297G)(Y349C)-GDF15(N3D):DhCpmFc(+)(N297G)(S354C)" in the instant disclosure refers to a heterodimer comprising (i) a first polypeptide chain comprising a GDF15(N3D) polypeptide, the N-terminus of which is linked directly to the C-terminus of a DhCpmFc(−)(N297G)(Y349C) domain, and (ii) a second polypeptide chain comprising a DhCpmFc(+)(N297G)(S345C) domain, The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two DhCpmFc(−)(N297G)(Y349C)-GDF15(N3D):DhCpmFc(+)(N297G)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(S354C) domains (one each heterodimer) comprising the sequence of SEQ ID NO:288, (b) two DhCpmFc(−)(N297G)(Y349C) domains comprising the sequence of SEQ ID NO:141, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 146)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 145)
gcacctgaactcctgggggaccgtcagtcttcctcttcccccaaacc caaggacaccctcatgatctcccggacccctgaggtcacatgcgtggtgg tggacgtgagccacgaagaccctgaggtcaagttcaactggtacgtggac ggcgtggaggtgcataatgccaagacaaagccgcgggaggagcagtacgg gagcacgtaccgtgtggtcagcgtcctcaccgtcctgcaccaggactggc tgaatggcaaggagtacaagtgcaaggtctccaacaaagccctcccagcc cccatcgagaaaccatctccaaagccaaagggcagccccgagaaccaca ggtgtgcaccctgcccccatcccgggaggagatgaccaagaaccaggtca

```
gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcagggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.
```

In a preferred embodiment, the second polypeptide chain comprises the amino acid sequence of SEQ ID NO:140, which is encoded by the nucleic acid sequence of SEQ ID NO:144.

As discussed above, a tetramer is provided comprising two polypeptide chains comprising the sequence of SEQ ID NO:146 and two polypeptide chains comprising the sequence of SEQ ID NO:140.

II.H.6 DhCpmFc(−)(N297G)(L351C)-GDF15(Ndel3):DhCpmFc(+)(N297G)(L351C)

The designation "DhCpmFc(−)(N297G)(L351C)-GDF15(Ndel3):DhCpmFc(+)(N297G)(L351C)" in the instant disclosure refers to a heterodimer comprising (i) a first polypeptide chain comprising a GDF15(Ndel3) polypeptide, the N-terminus of which is linked directly to the C-terminus of a DhCpmFc(−)(N297G)(L351C) domain, and (ii) a second polypeptide chain comprising a DhCpmFc(+)(N297G)(L351C) domain. The cysteine clamp mutations allow the first and second polypeptide chains to be linked via an interchain disulfide bond between C351 of the first polypeptide chain and C351 of the second polypeptide chain.

In certain embodiments, a tetramer is provided, comprising a dimer of two DhCpmFc(−)(N297G)(L351C)-GDF15(Ndel3):DhCpmFc(+)(N297G)(L351C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(L351C) domains (one each heterodimer) comprising the sequence:

```
                                        (SEQ ID NO: 289)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTCPPSREEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG,
```

(b) two DhCpmFc(−)(N297G)(L351C) domains (one each heterodimer) comprising the sequence:

```
                                        (SEQ ID NO: 148)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTCPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG,
``` and (c) two GDF15(Ndel3) polypeptides (one each heterodimer) comprising the sequence of SEQ ID NO:55.

In a preferred embodiment, the first polypeptide chain comprises the amino acid sequence:

```
                                        (SEQ ID NO: 150)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTCPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGARNGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI,
``` which is encoded by the nucleic acid sequence:

```
                                        (SEQ ID NO: 149)
gcgccggaactgctgggcggcccgagcgtgtttctgtttccgccgaaacc gaaagatacccctgatgattagccgcaccccggaagtgacctgcgtggtgg tggatgtgagccatgaagatccggaagtgaaatttaactggtatgtggat ggcgtggaagtgcataacgcgaaaaccaaaccgcgcgaagaacagtatgg cagcacctatcgcgtggtgagcgtgctgaccgtgctgcatcaggattggc tgaacggcaaagaatataaatgcaaagtgagcaacaaagcgctgccggcg ccgattgaaaaaaccattagcaaagcgaaaggccagccgcgcgaaccgca ggtgtatacctgcccgccgagccgcaaagaaatgaccaaaaaccaggtga gcctgacctgcctggtgaaaggcttttatccgagcgatattgcggtggaa tgggaaagcaacggccagccggaaaacaactataaaaccacccccgccggt gctgaaaagcgatggcagcttttttctgtatagcaaactgaccgtggata aaagccgctggcagcagggcaacgtgtttagctgcagcgtgatgcatgaa gcgctgcataaccattatacccagaaaagcctgagcctgagcccgggcgc gcgcaacggcgatcattgcccgctgggcccgggccgctgctgccgcctgc ataccgtgcgcgcgagcctggaagatctgggctgggcggattgggtgctg agcccgcgcgaagtgcaggtgaccatgtgcattggcgcgtgcccgagcca gtttcgcgcggcgaacatgcatgcgcagattaaaaccagcctgcatcgcc tgaaaccggataccgtgccggcgccgtgctgcgtgccggcgagctataac ccgatggtgctgattcagaaaaccgataccggcgtgagcctgcagaccta tgatgatctgctggcgaaagattgccattgcatt.
```

In a preferred embodiment, the second polypeptide chain comprises the amino acid sequence:

(SEQ ID NO: 147)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTCPPSREEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 151)
gcacctgaactcctgggggaccgtcagtcttcctcttcccccaaaacc caaggacaccctcatgatctcccgaccctgaggtcacatgcgtggtgg tggacgtgagccacgaagaccctgaggtcaagttcaactggtacgtggac ggcgtggaggtgcataatgccaagacaaagccgcgggaggagcagtacgg gagcacgtaccgtgtggtcagcgtcctcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacacctgtcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcagggggaacgtcttctcatgctccgtgatgcatgag gctctgcacaaccactacacgcagaagagcctctccctgtctccgggtaa a.

As discussed above, a tetramer is provided comprising two polypeptide chains comprising the sequence of SEQ ID NO:150 and two polypeptide chains comprising the sequence of SEQ ID NO:147.

II.H.7 DhCpmFc(−)(N297G)(L351C)-GDF15(N3D):DhCpmFc(+)(N297G)(L351C)

The designation "DhCpmFc(−)(N297G)(L351C)-GDF15(N3D):DhCpmFc(+)(N297G)(L351C)" in the instant disclosure refers to a heterodimer comprising (i) a first polypeptide chain comprising a GDF15(N3D) polypeptide, the N-terminus of which is linked directly to the C-terminus of a DhCpmFc(−)(N297G)(L351C) domain by a peptide bond and (ii) a second polypeptide chain comprising a DhCpmFc(+)(N297G)(L351C) domain. The cysteine clamp mutations allow the first and second polypeptide chains to be linked via an interchain disulfide bond between C351 of the first polypeptide chain and C351 of the second polypeptide chain.

In certain embodiments, a tetramer is provided, comprising a dimer of two DhCpmFc(−)(N297G)(L351C)-GDF15(N3D):DhCpmFc(+)(N297G)(L351C) heterodimers in which the two first polypeptide chains of each heterodimer are linked via an interchain disulfide bond between their respective GDF15 regions.

More particularly, in a specific embodiment, the tetramer comprises:
 (a) two DhCpmFc(+)(N297G)(L351C) domains (one each heterodimer) comprising the sequence of SEQ ID NO:289,
 (b) two DhCpmFc(−)(N297G)(L351C) domains (one each heterodimer) comprising the sequence of SEQ ID NO:148, and
 (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 153)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVYTCPPSRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 152)
gcgccggaactgctgggcggcccgagcgtgtttctgtttccgccgaaacc gaaagatacctgatgattagccgcacccggaagtgacctgcgtggtgg tggatgtgagccatgaagatccggaagtgaaatttaactggtatgtggat ggcgtggaagtgcataacgcgaaaaccaaaccgcgcgaagaacagtatgg cagcacctatcgcgtggtgagcgtgctgaccgtgctgcatcaggattggc tgaacggcaaagaatataaatgcaaagtgagcaacaaagcgctgccggcg ccgattgaaaaaaccattagcaaagcgaaaggccagccgcgcgaaccgca ggtgtatacctgcccgccgagccgcaaagaaatgaccaaaaaccaggtga gcctgacctgcctggtgaaaggcttttatccgagcgatattgcggtggaa tgggaaagcaacggccagccggaaaacaactataaaaccacccccgccggt gctgaaaagcgatggcagcttttttctgtatagcaaactgaccgtggata aaagccgctggcagcagggcaacgtgtttagctgcagcgtgatgcatgaa gcgctgcataaccattatacccagaaaagcctgagcctgagcccgggcgc gcgcgatggcgatcattgcccgctgggcccgggccgctgctgccgcctgc ataccgtgcgcgcgagcctggaagatctgggctgggcggattgggtgctg agcccgcgcgaagtgcaggtgaccatgtgcattggcgcgtgcccgagcca gtttcgcgcggcgaacatgcatgcgcagattaaaaccagcctgcatcgcc tgaaaccggataccgtgccggcgccgtgctgcgtgccggcgagctataac ccgatggtgctgattcagaaaaccgataccggcgtgagcctgcagaccta tgatgatctgctggcgaaagattgccattgcatt.

In a preferred embodiment, the second polypeptide chain comprises the amino acid sequence of SEQ ID NO:147, which is encoded by the nucleic acid sequence of SEQ ID NO:151.

As discussed above, a tetramer is provided comprising two polypeptide chains comprising the sequence of SEQ ID NO:153 and two polypeptide chains comprising the sequence of SEQ ID NO:147.

II.H.8 DhCpmFc(−)(N297G)(A287C)-GDF15(Ndel3):DhCpmFc(+)(N297G)(L306C)

The designation "DhCpmFc(−)(N297G)(A287C)-GDF15(Ndel3):DhCpmFc(+)(N297G)(L306C)" in the instant disclosure refers to a heterodimer comprising (i) a first polypeptide chain comprising a GDF15(Ndel3) polypeptide, the N-terminus of which is linked directly to the C-terminus of a DhCpmFc(−)(N297G)(A287C) domain, and (ii) a second polypeptide chain comprising a DhCpmFc(+)(N297G)(L306C) domain.

In certain embodiments, a tetramer is provided, comprising a dimer of two DhCpmFc(−)(N297G)(A287C)-GDF15 (Ndel3):DhCpmFc(+)(N297G)(L306C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(L306C) domains (one each heterodimer) comprising the sequence:

(SEQ ID NO: 290)
APELLGGPSVFLFPPKPKDTLMISRTPEVTCVVVDVSHEDPEVKFNWYVD
GVEVHNCKTKPREEQYGSTYRVVSVCTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPG, (b) two DhCpmFc(−)(N297G)(A287C) domains (one each heterodimer) comprising the sequence:

(SEQ ID NO: 268)
APELLGGPSVFLFPPKPKDTLMISRTPEVTCVVVDVSHEDPEVKFNWYVD
GVEVHNCKTKPREEQYGSTYRVVSVCTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 269)
APELLGGPSVFLFPPKPKDTLMISRTPEVTCVVVDVSHEDPEVKFNWYVD
GVEVHNCKTKPREEQYGSTYRVVSVCTVLHQDWLNGKEYKCKVSNKALPA
PIEKTISKAKGQPREPQVYTLPPSREEMTKNQVSLTCLVKGFYPSDIAVE
WESNGQPENNYDTTPPVLDSDGSFFLYSDLTVDKSRWQQGNVFSCSVMHE
ALHNHYTQKSLSLSPGGDHCPLGPGRCCRLHTVRASLEDLGWADWVLSPR
EVQVTMCIGACPSQFRAANMHAQIKTSLHRLKPDTVPAPCCVPASYNPMV
LIQKTDTGVSLQTYDDLLAKDCHCI, which is encoded by the nucleic acid sequence:

(SEQ ID NO: 270)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggcccgggcgttgctgcgctctgcacacggtcc gcgcgtcgctggaagacctgggctgggccgattgggtgctgtcgccacgg gaggtgcaagtgaccatgtgcatcggcgcgtgcccgagccagttccgggc ggcaaacatgcacgcgcagatcaagacgagcctgcaccgcctgaagcccg acacggtgccagcgcctgctgcgtgcccgcagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence:

(SEQ ID NO: 267)
APELLGGPSVFLFPPKPKDTLMISRTPEVTCVVVDVSHEDPEVKFNWYVD
GVEVHNCKTKPREEQYGSTYRVVSVCTVLHQDWLNGKEYKCKVSNKALPA
PIEKTISKAKGQPREPQVYTLPPSRKEMTKNQVSLTCLVKGFYPSDIAVE
WESNGQPENNYKTTPPVLKSDGSFFLYSKLTVDKSRWQQGNVFSCSVMHE
ALHNHYTQKSLSLSPGK, which is encoded by the nucleic acid sequence:

(SEQ ID NO: 271)
gcacctgaactcctggggggaccgtcagtcttcctcttcccccaaaacc caaggacaccctcatgatctcccggacccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgcccccatcccggaaggagatgaccaagaaccaggtca gcctgacctgcctggtcaaaggcttctatcccagcgacatcgccgtggag tgggagagcaatgggcagccggagaacaactacaagaccacgcctcccgt gctgaagtccgacggctccttcttcctctatagcaagctcaccgtggaca agagcaggtggcagcaggggaacgtcttctcatgctccgtgatgcatgag gctctgcacaaccactacacgcagaagagcctctccctgtctccgggtaa a.

As discussed above, a tetramer is provided comprising two polypeptide chains comprising the sequence of SEQ ID NO:269 and two polypeptide chains comprising the sequence of SEQ ID NO:267.

II.H.9 DhCpmFc(−)(N297G)(A287C)-GDF15(N3D):DhCpmFc(+)(N297G)(L306C)

The designation "DhCpmFc(−)(N297G)(A287C)-GDF15 (N3D):DhCpmFc(+)(N297G)(L306C)" in the instant disclosure refers to a heterodimer comprising (i) a first polypeptide chain comprising a GDF15(N3D) polypeptide, the N-terminus of which is linked directly to the C-terminus of a DhCpmFc(−)(N297G)(A287C) domain, and (ii) a second polypeptide chain comprising a DhCpmFc(+)(N297G) (L306C) domain.

In certain embodiments, a tetramer is provided, comprising a dimer of two DhCpmFc(−)(N297G)(A287C)-GDF15 (N3D):DhCpmFc(+)(N297G)(L306C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(L306C) domains (one each heterodimer) comprising the sequence of SEQ ID NO:290, (b) two DhCpmFc(−)(N297G)(A287C) domains (one each heterodimer) comprising the sequence of SEQ ID NO:268, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 272)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVYTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 273)
gcacctgaactcctggggggaccgtcagtcttcctcttcccccaaaacc caaggacaccctcatgatctcccggaccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtcctgcaccaggactggc tgaatggcaaggagtacaagtgcaaggtctccaacaaagccctcccagcc cccatcgagaaaaccatctccaaagccaaagggcagccccgagaaccaca ggtgtacaccctgccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacgggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.

In a preferred embodiment, the second polypeptide chain comprises the amino acid sequence of SEQ ID NO:267, which is encoded by the nucleic acid sequence of SEQ ID NO:271.

As discussed above, a tetramer is provided comprising two polypeptide chains comprising the sequence of SEQ ID NO:272 and two polypeptide chains comprising the sequence of SEQ ID NO:267.

II.H.10 DhCpmFc(−)(N297G)(A287C)(Y349C)-GDF15 (Ndel3):DhCpmFc(+)(N297G)(L306C)(S354C)

The designation "DhCpmFc(−)(N297G)(A287C) (Y349C)-GDF15(Ndel3):DhCpmFc(+)(N297G)(L306C) (S354C)" in the instant disclosure refers to a heterodimer comprising (i) a first polypeptide chain comprising a GDF15 (Ndel3) polypeptide, the N-terminus of which is linked directly to the C-terminus of a DhCpmFc(−)(N297G) (A287C)(Y349C) domain, and (ii) a second polypeptide chain comprising a DhCpmFc(+)(N297G)(L306C)(S354C) domain.

In certain embodiments, a tetramer is provided, comprising a dimer of two DhCpmFc(−)(N297G)(A287C)(Y349C)-GDF15(Ndel3):DhCpmFc(+)(N297G)(L306C)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(L306C)(Y349C) domains (one each heterodimer) comprising the sequence:

(SEQ ID NO: 291)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPG, (b) two DhCpmFc(−)(N297G)(A287C)(S354C) domains (one each heterodimer) comprising the sequence:

(SEQ ID NO: 275)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVCTLPPSREEMTKNQVSLTCLVKGFYPSDIAVE

-continued

WESNGQPENNYDTTPPVLDSDGSFFLYSDLTVDKSRWQQGNVFSCSVMHE

ALHNHYTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 276)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGGDHCPLGPGRCCRLHTVRASLEDLGWADWVLSPR

EVQVTMCIGACPSQFRAANMHAQIKTSLHRLKPDTVPAPCCVPASYNPMV

LIQKTDTGVSLQTYDDLLAKDCHCI, which is encoded by the nucleic acid sequence:

(SEQ ID NO: 277)
gcacctgaactcctggggggaccgtcagtcttcctcttcccccccaaaacc caaggacaccctcatgatctcccggacccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtcctgcaccaggactggc tgaatggcaaggagtacaagtgcaaggtctccaacaaagccctcccagcc cccatcgagaaaaccatctccaaagccaaaggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgg agaccactgtccgctcgggccgggcgttgctgccgtctgcacacggtcc gcgcgtcgctggaagacctgggctgggccgattgggtgctgtcgccacgg gaggtgcaagtgaccatgtgcatcggcgcgtgcccgagccagttccggc ggcaaacatgcacgcgcagatcaagacgagcctgcaccgcctgaagcccg acacggtgccagcgcctgctgcgtgcccgccagctacaatcccatggtg ctcattcaaaagaccgacaccggggtgtcgctccagacctatgatgactt gttagccaaagactgccactgcata.

In a preferred embodiment, the second polypeptide chain comprises the amino acid sequence:

(SEQ ID NO: 274)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVYTLPPCRKEMTKNQVSLTCLVKGFYPSDIAVE

WESNGQPENNYKTTPPVLKSDGSFFLYSKLTVDKSRWQQGNVFSCSVMHE

ALHNHYTQKSLSLSPGK, which is encoded by the nucleic acid sequence:

(SEQ ID NO: 278)
gcacctgaactcctggggggaccgtcagtcttcctcttcccccccaaaacc caaggacaccctcatgatctcccggacccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtgctccaccaggactggc ttaatgggaaggaatacaagtgtaaggtgtccaacaaggccctccccgct cccatcgaaaagaccatctcaaaggcaaaggggcaaccaagggaacctca agtgtacaccctgcctccgtgcaggaaggagatgaccaagaaccaggtca gcctgacttgtctcgtgaagggcttctatcccagcgatattgctgtggaa tgggagtcaaatggccagcccgagaataactacaaaactaccccacccgt gctgaaatctgatgggtccttcttcctttactccaagctgaccgtggaca agagccgctggcaacaaggcaatgtctttagctgctcagtgatgcatgag gctctccataatcactacactcagaagtcactgtccctgtctccgggtaa a.

As discussed above, a tetramer is provided comprising two polypeptide chains comprising the sequence of SEQ ID NO:276 and two polypeptide chains comprising the sequence of SEQ ID NO:274.

II.H.11 DhCpmFc(−)(N297G)(A287C)(Y349C)-GDF15(N3D):DhCpmFc(+)(N297G)(L306C)(S354C)

The designation "DhCpmFc(−)(N297G)(Y349C)-GDF15(N3D):DhCpmFc(+)(N297G)(L306C)(S354C)" in the instant disclosure refers to a heterodimer comprising (i) a first polypeptide chain comprising a GDF15(N3D) polypeptide, the N-terminus of which is linked directly to the C-terminus of a DhCpmFc(−)(N297G)(A287C)(Y349C) domain, and (ii) a second polypeptide chain comprising a DhCpmFc(+)(N297G)(L306C)(S354C) domain.

In certain embodiments, a tetramer is provided, comprising a dimer of two DhCpmFc(−)(N297G)(A287C)(Y349C)-GDF15(N3D):DhCpmFc(+)(N297G)(L306C)(S354C) heterodimers in which the two first polypeptide chains of each heterodimer are linked via an interchain disulfide bond between their respective GDF15 regions.

More particularly, in a specific embodiment, the tetramer comprises:

(a) two DhCpmFc(+)(N297G)(L306C)(Y349C) domains (one each heterodimer) comprising the sequence of SEQ ID NO:291, (b) two DhCpmFc(−)(N297G)(A287C)(S354C) domains (one each heterodimer) comprising the sequence of SEQ ID NO:275, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 279)
APELLGGPSVFLFPPKPKDTLMISRTPEVTCVVVDVSHEDPEVKFNWYVD

GVEVHNCKTKPREEQYGSTYRVVSVCTVLHQDWLNGKEYKCKVSNKALPA

PIEKTISKAKGQPREPQVCTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARDGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 280)
gcacctgaactcctgggggaccgtcagtcttcctcttccccccaaaacc caaggacaccctcatgatctcccggacccctgaggtcacatgcgtggtgg tggacgtgagccacgaagaccctgaggtcaagttcaactggtacgtggac ggcgtggaggtgcataattgcaagacaaagccgcgggaggagcagtacgg cagcacgtaccgtgtggtcagcgtctgcaccgtcctgcaccaggactggc tgaatggcaaggagtacaagtgcaaggtctccaacaaagccctcccagcc cccatcgagaaaaccatctccaaagccaaagggcagccccgagaaccaca ggtgtgcaccctgcccccatcccgggaggagatgaccaagaaccaggtca gcctgacctgcctggtcaaaggcttctatcccagcgacatcgccgtggag tgggagagcaatgggcagccggagaacaactacgacaccacgcctcccgt gctggactccgacggctccttcttcctctatagcgacctcaccgtggaca agagcaggtggcagcaggggaacgtcttctcatgctccgtgatgcatgag gctctgcacaaccactacacgcagaagagcctctccctgtctccgggtgc gcgcgacggagaccactgtccgctcgggcccgggcgttgctgccgtctgc acacggtccgcgcgtcgctggaagacctgggctgggccgattgggtgctg tcgccacggggaggtgcaagtgaccatgtgcatcggcgcgtgcccgagcca gttccgggcggcaaacatgcacgcgcagatcaagacgagcctgcaccgcc tgaagcccgacacggtgccagcgccctgctgcgtgcccgccagctacaat cccatggtgctcattcaaaagaccgacaccggggtgtcgctccagaccta tgatgacttgttagccaaagactgccactgcata.

In a preferred embodiment, the second polypeptide chain comprises the amino acid sequence of SEQ ID NO:274, which is encoded by the nucleic acid sequence of SEQ ID NO:278.

As discussed above, a tetramer is provided comprising two polypeptide chains comprising the sequence of SEQ ID NO:279 and two polypeptide chains comprising the sequence of SEQ ID NO:274.

II.H.12 Dh2CpmFc(−)-GDF15(Ndel3):Dh2CpmFc(+)

The designation "Dh2CpmFc(−)-GDF15(Ndel3):Dh2CpmFc(+)" in the instant disclosure refers to a heterodimer comprising (i) a first polypeptide chain comprising a GDF15(Ndel3) polypeptide, the N-terminus of which is linked directly to the C-terminus of a Dh2CpmFc(−) domain, and (ii) a second polypeptide chain comprising a Dh2CpmFc(+) domain.

In certain embodiments, a tetramer is provided, comprising a dimer of two Dh2CpmFc(−)-GDF15(Ndel3):Dh2CpmFc(+) heterodimers in which the two first polypeptide chains of each heterodimer are linked via an interchain disulfide bond between their respective GDF15 regions.

More particularly, in a specific embodiment, the tetramer comprises:

(a) two Dh2CpmFc(+) domains (one each heterodimer) comprising the sequence:

(SEQ ID NO: 292)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPG, (b) two Dh2CpmFc(−) domains (one each heterodimer) comprising the sequence:

(SEQ ID NO: 155)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPG, and
(c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 157)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGGDHCPLGPGRCCRLHTVRASLEDLGWADWVLSPREVQVTMC

IGACPSQFRAANMHAQIKTSLHRLKPDTVPAPCCVPASYNPMVLIQKTDT

GVSLQTYDDLLAKDCHCI, which is encoded by the nucleic acid sequence:

(SEQ ID NO: 156)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacaacagcacgtaccgtgtggtcag cgtcctcaccgtcctgcaccaggactggctgaatggcaaggagtacaagt gcaaggtctccaacaaagccctcccagccccatcgagaaaaccatctcc aaagccaaagggcagccccgagaaccacaggtgtacaccctgcccccatc ccgggaggagatgaccaagaaccaggtcagcctgacctgcctggtcaaag -continued
```
gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtggagaccactgtccgctcgggcc cgggcgttgctgccgtctgcacacggtccgcgcgtcgctggaagacctgg gctgggccgattgggtgctgtcgccacgggaggtgcaagtgaccatgtgc atcggcgcgtgcccgagccagttccgggcggcaaacatgcacgcgcagat caagacgagcctgcaccgcctgaagcccgacacggtgccagcgccctgct gcgtgcccgccagctacaatcccatggtgctcattcaaaagaccgacacc ggggtgtcgctccagacctatgatgacttgttagccaaagactgccactg cata.
```

In a preferred embodiment, the second polypeptide chain comprises the amino acid sequence:

```
                                       (SEQ ID NO: 154)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPGK,
``` which is encoded by the nucleic acid sequence:

```
                                       (SEQ ID NO: 158)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacaacagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtacaccctgcccccatc ccggaaggagatgaccaagaaccaggtcagcctgacctgcctggtcaaag gcttctatcccagcgacatcgccgtggagtgggagagcaatgggcagccg gagaacaactacaagaccacgcctcccgtgctgaagtccgacggctcctt cttcctctatagcaagctcaccgtggacaagagcaggtggcagcagggga acgtcttctcatgctccgtgatgcatgaggctctgcacaaccactacacg cagaagagcctctccctgtctccgggtaaatga
```

As discussed above, a tetramer is provided comprising two polypeptide chains comprising the sequence of SEQ ID NO:157 and two polypeptide chains comprising the sequence of SEQ ID NO:154.

II.H.13 Dh2CpmFc(−)-GDF15(N3D):Dh2CpmFc(+)

The designation "Dh2CpmFc(−)-GDF15(N3D):Dh2CpmFc(+)" in the instant disclosure refers to a heterodimer comprising (i) a first polypeptide chain comprising a GDF15(N3D) polypeptide, the N-terminus of which is linked directly to the C-terminus of a Dh2CpmFc(−) domain by a peptide bond, and (ii) a second polypeptide chain comprising a Dh2CpmFc(+) domain.

In certain embodiments, a tetramer is provided, comprising a dimer of two Dh2CpmFc(−)-GDF15(N3D):DhCpmFc(+) heterodimers in which the two first polypeptide chains of each heterodimer are linked via an interchain disulfide bond between their respective GDF15 regions.

More particularly, in a specific embodiment, the tetramer comprises:
(a) two Dh2CpmFc(+) domains (one each heterodimer) comprising the sequence of SEQ ID NO:292,
(b) two Dh2CpmFc(−) domains (one each heterodimer) comprising the sequence of SEQ ID NO:155, and
(c) two GDF15(N3D) polypeptides (one each heterodimer) comprising the sequence of SEQ ID NO:52.

In a preferred embodiment, the first polypeptide chain comprises the amino acid sequence:

```
                                       (SEQ ID NO: 160)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI,
``` which is encoded by the nucleic acid sequence:

```
                                       (SEQ ID NO: 159)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacaacagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtacaccctgcccccatc ccggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtgcgcgcgacggagaccactgtcc gctcgggcccgggcgttgctgccgtctgcacacggtccgcgcgtcgctgg aagacctgggctgggccgattgggtgctgtcgccacgggaggtgcaagtg accatgtgcatcggcgcgtgcccgagccagttccgggcggcaaacatgca cgcgcagatcaagacgagcctgcaccgcctgaagcccgacacggtgccag cgccctgctgcgtgcccgccagctacaatcccatggtgctcattcaaaag accgacaccggggtgtcgctccagacctatgatgacttgttagccaaaga ctgccactgcata.
```

In a preferred embodiment, the second polypeptide chain comprises the amino acid sequence of SEQ ID NO:154, which is encoded by the nucleic acid sequence of SEQ ID NO:158.

As discussed above, a tetramer is provided comprising two polypeptide chains comprising the sequence of SEQ ID NO:160 and two polypeptide chains comprising the sequence of SEQ ID NO:154.

II.H.14 Dh2CpmFc(−)(Y349C)-GDF15(Ndel3):Dh2CpmFc(+)(S354C)

The designation "Dh2CpmFc(−)(Y349C)-GDF15(Ndel3):Dh2CpmFc(+)(S354C)" in the instant disclosure refers to a heterodimer comprising (i) a first polypeptide chain comprising a GDF15(Ndel3) polypeptide, the N-terminus of which is linked directly to the C-terminus of a Dh2CpmFc(−)(Y349C) domain, and (ii) a second polypeptide chain comprising a Dh2CpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two Dh2CpmFc(−)(Y349C)-GDF15(Ndel3):Dh2CpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two Dh2CpmFc(+)(S354C) domains (one each heterodimer) comprising the sequence:

(SEQ ID NO: 293)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPG, (b) two Dh2CpmFc(−)(Y349C) domains (one each heterodimer) comprising the sequence:

(SEQ ID NO: 162)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 164)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGGDHCPLGPGRCCRLHTVRASLEDLGWADWVLSPREVQVTMC

IGACPSQFRAANMHAQIKTSLHRLKPDTVPAPCCVPASYNPMVLIQKTDT

GVSLQTYDDLLAKDCHCI, which is encoded by the nucleic acid sequence:

(SEQ ID NO: 163)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacaacagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtgcaccctgccccatc ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtggagaccactgtccgctcgggcc cgggcgttgctgccgtctgcacacggtccgcgcgtcgctggaagacctgg gctgggccgattgggtgctgtcgccacgggaggtgcaagtgaccatgtgc atcggcgcgtgcccgagccagttccgggcggcaaacatgcacgcgcagat caagacgagcctgcaccgcctgaagcccgacacggtgccagcgccctgct gcgtgcccgccagctacaatcccatggtgctcattcaaaagaccgacacc ggggtgtcgctccagacctatgatgacttgttagccaaagactgccactg cata.

In a preferred embodiment, the second polypeptide chain comprises the amino acid sequence:

(SEQ ID NO: 161)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPGK, which is encoded by the nucleic acid sequence:

(SEQ ID NO: 165)
ccatccgtgttcctgtttcctccaaagccgaaggacaccctgatgatctc aagaactccggaagtgacttgcgtcgtcgtggacgtgtcacatgaggatc cagaggtcaagttcaattggtatgtggacggagtggaagtgcataacgcc aagaccaaacccgcgaagaacagtacaatagcacctaccgcgtggtgag -continued cgtccttactgtgctccaccaggactggcttaatgggaaggaatacaagt gtaaggtgtccaacaaggccctccccgctcccatcgaaaagaccatctca aaggcaaaggggcaaccaagggaacctcaagtgtacaccctgcctccgtg caggaaggagatgaccaagaaccaggtcagcctgacttgtctcgtgaagg gcttctatcccagcgatattgctgtggaatgggagtcaaatggccagccc gagaataactacaaaactacccccacccgtgctgaaatctgatgggtcctt cttcctttactccaagctgaccgtggacaagagccgctggcaacaaggca atgtctttagctgctcagtgatgcatgaggctctccataatcactacact cagaagtcactgtccctgtctccgggtaaa.

As discussed above, a tetramer is provided comprising two polypeptide chains comprising the sequence of SEQ ID NO:164 and two polypeptide chains comprising the sequence of SEQ ID NO:161.

II.H.15 Dh2CpmFc(−)(Y349C)-GDF15(N3D):Dh2CpmFc(+)(S354C)

The designation "Dh2CpmFc(−)(Y349C)-GDF15(N3D):Dh2CpmFc(+)(S354C)" in the instant disclosure refers to a heterodimer comprising (i) a first polypeptide chain comprising a GDF15(N3D) polypeptide, the N-terminus of which is linked directly to the C-terminus of a Dh2CpmFc(−)(Y349C) domain, and (ii) a second polypeptide chain comprising a Dh2CpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two Dh2CpmFc(−)(Y349C)-GDF15(N3D):Dh2CpmFc(+)(S354C) heterodimers in which two first polypeptide chains of each heterodimer are linked via an interchain disulfide bond between their respective GDF15 regions.

More particularly, in a specific embodiment, the tetramer comprises:
(a) two Dh2CpmFc(+)(S354C) domains (one each heterodimer) comprising the sequence of SEQ ID NO:293,
(b) two Dh2CpmFc(−)(Y349C) domains (one each heterodimer) comprising the sequence of SEQ ID NO:162, and
(c) two GDF15(N3D) polypeptides (one each heterodimer) comprising the sequence of SEQ ID NO:52.

In a preferred embodiment, the first polypeptide chain comprises the amino acid sequence:

(SEQ ID NO: 167)
PSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI, which is encoded by the nucleic acid sequence:

(SEQ ID NO: 166)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacaacagcacgtaccgtgtggtcag cgtcctcaccgtcctgcaccaggactggctgaatggcaaggagtacaagt gcaaggtctccaacaaagcccctcccagcccccatcgagaaaaccatctcc aaagccaaagggcagccccgagaaccacaggtgtgcaccctgcccccatc ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtgcgcgcgacggagaccactgtcc gctcgggcccgggcgttgctgccgtctgcacacggtccgcgcgtcgctgg aagacctgggctgggccgattgggtgctgtcgccacgggaggtgcaagtg accatgtgcatcggcgcgtgcccgagccagttccgggcggcaaacatgca cgcgcagatcaagacgagcctgcaccgcctgaagcccgacacggtgccag cgccctgctgcgtgcccgccagctacaatcccatggtgctcattcaaaag accgacaccggggtgtcgctccagacctatgatgacttgttagccaaaga ctgccactgcata.

In a preferred embodiment, the second monomer comprises the amino acid sequence of SEQ ID NO:161, which is encoded by the nucleic acid sequence of SEQ ID NO:165.

As discussed above, a tetramer is provided comprising two polypeptide chains comprising the sequence of SEQ ID NO:167 and two polypeptide chains comprising the sequence of SEQ ID NO:161.

II.H.16 CpmFc(−)(N297G)-GDF15(Ndel3):CpmFc(+)(N297G)

The designation "CpmFc(−)(N297G)-GDF15(Ndel3):DhCpmFc(+)(N297G)" in the instant disclosure refers to a heterodimer comprising (i) a first polypeptide chain comprising a GDF15(Ndel3) polypeptide, the N-terminus of which is linked directly to the C-terminus of a CpmFc(−)(N297G) domain, and (ii) a second polypeptide chain comprising a CpmFc(+)(N297G) domain.

In certain embodiments, a tetramer is provided, comprising a dimer of two CpmFc(−)(N297G)-GDF15(Ndel3):CpmFc(+)(N297G) heterodimers in which the two first polypeptide chains of each heterodimer are linked via an interchain disulfide bond between their respective GDF15 regions.

More particularly, in a specific embodiment, the tetramer comprises:
(a) two CpmFc(+)(N297G) domains (one each heterodimer) comprising the sequence (part of the hinge region in parentheses):

(SEQ ID NO: 294)
(DKTHTCPPCP)APELLGGPSVFLFPPKPKDTLMISRTPEVTCVVVDVSH

EDPEVKFNWYVDGVEVHNAKTKPREEQYGSTYRVVSVLTVLHQDWLNGKE

YKCKVSNKALPAPIEKTISKAKGQPREPQVYTLPPSRKEMTKNQVSLTCL

-continued

VKGFYPSDIAVEWESNGQPENNYKTTPPVLKSDGSFFLYSKLTVDKSRWQ

QGNVFSCSVMHEALHNHYTQKSLSLSPG, (b) two CpmFc(-)(N297G) domains (one each heterodimer) comprising the sequence (part of the hinge region in parentheses):

(SEQ ID NO: 169)
(DKTHTCPPCP)APELLGGPSVFLFPPKPKDTLMISRTPEVTCVVVDVSH

EDPEVKFNWYVDGVEVHNAKTKPREEQYGSTYRVVSVLTVLHQDWLNGKE

YKCKVSNKALPAPIEKTISKAKGQPREPQVYTLPPSREEMTKNQVSLTCL

VKGFYPSDIAVEWESNGQPENNYDTTPPVLDSDGSFFLYSDLTVDKSRWQ

QGNVFSCSVMHEALHNHYTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 171)
(DKTHTCPPCP)APELLGGPSVFLFPPKPKDTLMISRTPEVTCVVVDVSH

EDPEVKFNWYVDGVEVHNAKTKPREEQYGSTYRVVSVLTVLHQDWLNGKE

YKCKVSNKALPAPIEKTISKAKGQPREPQVYTLPPSREEMTKNQVSLTCL

VKGFYPSDIAVEWESNGQPENNYDTTPPVLDSDGSFFLYSDLTVDKSRWQ

QGNVFSCSVMHEALHNHYTQKSLSLSPGGDHCPLGPGRCCRLHTVRASLE

DLGWADWVLSPREVQVTMCIGACPSQFRAANMHAQIKTSLHRLKPDTVPA

PCCVPASYNPMVLIQKTDTGVSLQTYDDLLAKDCHCI, which is encoded by the nucleic acid sequence:

(SEQ ID NO: 170)
gacaaaactcacacatgcccaccgtgcccagcacctgaactcc tggggggaccgtcagtcttcctcttccccccaaaacccaaggacaccctc atgatctcccggacccctgaggtcacatgcgtggtggtggacgtgagcca cgaagaccctgaggtcaagttcaactggtacgtggacggcgtggaggtgc ataatgccaagacaaagccgcgggaggagcagtacggcagcacgtaccgt gtggtcagcgtcctcaccgtcctgcaccaggactggctgaatggcaagga gtacaagtgcaaggtctccaacaaagccctcccagccccatcgagaaaa ccatctccaaagccaaagggcagccccgagaaccacaggtgtacaccctg cccccatcccgggaggagatgaccaagaaccaggtcagcctgacctgcct ggtcaaaggcttctatcccagcgacatcgccgtggagtgggagagcaatg ggcagccggagaacaactacgacaccacgcctcccgtgctggactccgac ggctccttcttcctctatagcgacctcaccgtggacaagagcaggtggca gcaggggaacgtcttctcatgctccgtgatgcatgaggctctgcacaacc actacacgcagaagagcctctccctgtctccgggtggagaccactgtccg ctcgggcccggcgttgctgccgtctgcacacggtccgcgcgtcgctgga agacctgggctgggccgattgggtgctgtcgcacgggaggtgcaagtga ccatgtgcatcggcgcgtgcccgagccagttccgggcggcaaacatgcac gcgcagatcaagacgagcctgcaccgcctgaagcccgacacggtgccagc gccctgctgcgtgcccgccagctacaatcccatggtgctcattcaaaaga ccgacaccggggtgtcgctccagacctatgatgacttgttagccaaagac tgccactgcata.

In a preferred embodiment, the second polypeptide chain comprises the amino acid sequence:

(SEQ ID NO: 168)
(DKTHTCPPCP)APELLGGPSVFLFPPKPKDTLMISRTPEVTCVVVDVSH

EDPEVKFNWYVDGVEVHNAKTKPREEQYGSTYRVVSVLTVLHQDWLNGKE

YKCKVSNKALPAPIEKTISKAKGQPREPQVYTLPPSRKEMTKNQVSLTCL

VKGFYPSDIAVEWESNGQPENNYKTTPPVLKSDGSFFLYSKLTVDKSRWQ

QGNVFSCSVMHEALHNHYTQKSLSLSPGK, which is encoded by the nucleic acid sequence:

(SEQ ID NO: 172)
gacaaaactcacacatgcccaccgtgcccagcacctgaactcc tggggggaccgtcagtcttcctcttccccccaaaacccaaggacaccctc atgatctcccggacccctgaggtcacatgcgtggtggtggacgtgagcca cgaagaccctgaggtcaagttcaactggtacgtggacggcgtggaggtgc ataatgccaagacaaagccgcgggaggagcagtacggcagcacgtaccgt gtggtcagcgtcctcaccgtcctgcaccaggactggctgaatggcaagga gtacaagtgcaaggtctccaacaaagccctcccagccccatcgagaaaa ccatctccaaagccaaagggcagccccgagaaccacaggtgtacaccctg cccccatcccgggaggagatgaccaagaaccaggtcagcctgacctgcct ggtcaaaggcttctatcccagcgacatcgccgtggagtgggagagcaatg ggcagccggagaacaactacaagaccacgcctcccgtgctgaagtccgac ggctccttcttcctctatagcaagctcaccgtggacaagagcaggtggca gcaggggaacgtcttctcatgctccgtgatgcatgaggctctgcacaacc actacacgcagaagagcctctccctgtctccgggtaaa.

As discussed above, a tetramer is provided comprising two polypeptide chains comprising the sequence of SEQ ID NO:171 and two polypeptide chains comprising the sequence of SEQ ID NO:168.

II.H.17 CpmFc(-)(N297G)-GDF15(N3D):CpmFc(+)(N297G)

The designation "CpmFc(-)(N297G)-GDF15(N3D):Dh-CpmFc(+)(N297G)" in the instant disclosure refers to a heterodimer comprising (i) a first polypeptide chain comprising a GDF15(N3D) polypeptide, the N-terminus of which is linked directly to the C-terminus of a CpmFc(-)(N297G) domain, and (ii) a second polypeptide chain comprising a CpmFc(+)(N297G) domain.

In certain embodiments, a tetramer is provided, comprising a dimer of two CpmFc(-)(N297G)-GDF15(N3D):CpmFc(+)(N297G) heterodimers in which the two first polypeptide chains of each heterodimer are linked via an interchain disulfide bond between their respective GDF15 regions.

More particularly, in a specific embodiment, the tetramer comprises:
 (a) two CpmFc(+)(N297G) domains (one each heterodimer) comprising the sequence of SEQ ID NO:294,
 (b) two CpmFc(−)(N297G) domains (one each heterodimer) comprising the sequence of SEQ ID NO:169, and
 (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 174)
(DKTHTCPPCP)APELLGGPSVFLFPPKPKDTLMISRTPEVTCVVVDVSH
EDPEVKFNWYVDGVEVHNAKTKPREEQYGSTYRVVSVLTVLHQDWLNGKE
YKCKVSNKALPAPIEKTISKAKGQPREPQVYTLPPSREEMTKNQVSLTCL
VKGFYPSDIAVEWESNGQPENNYDTTPPVLDSDGSFFLYSDLTVDKSRWQ
QGNVFSCSVMHEALHNHYTQKSLSLSPGARDGDHCPLGPGRCCRLHTVRA
SLEDLGWADWVLSPREVQVTMCIGACPSQFRAANMHAQIKTSLHRLKPDT
VPAPCCVPASYNPMVLIQKTDTGVSLQTYDDLLAKDCHCI, which is encoded by the nucleic acid sequence:

(SEQ ID NO: 173)
gacaaaactcacacatgcccaccgtgcccagcacctgaactcctggggg
accgtcagtcttcctcttccccccaaaacccaaggacaccctcatgatct
cccggacccctgaggtcacatgcgtggtggtggacgtgagccacgaagac
cctgaggtcaagttcaactggtacgtggacggcgtggaggtgcataatgc
caagacaaagccgcgggaggagcagtacggcagcacgtaccgtgtggtca
gcgtcctcaccgtcctgcaccaggactggctgaatggcaaggagtacaag
tgcaaggtctccaacaaagccctcccagccccatcgagaaaaccatctc
caaagccaaagggcagccccgagaaccacaggtgtacaccctgcccccat
cccgggaggagatgaccaagaaccaggtcagcctgacctgcctggtcaaa
ggcttctatcccagcgacatcgccgtggagtgggagagcaatgggcagcc
ggagaacaactacgacaccacgcctcccgtgctggactccgacggctcct
tcttcctctatagcgacctcaccgtggacaagagcaggtggcagcagggg
aacgtcttctcatgctccgtgatgcatgaggctctgcacaaccactacac
gcagaagagcctctccctgtctccgggtgcgcgcgacggagaccactgtc
cgctcgggcccgggcgttgctgccgtctgcacacggtccgcgcgtcgctg
gaagacctgggctggccgattgggtgctgtcgccacgggaggtgcaagt
gaccatgtgcatcggcgcgtgcccgagccagttccgggcggcaaacatgc
acgcgcagatcaagacgagcctgcaccgcctgaagcccgacacggtgcca
gcgccctgctgcgtgcccgccagctacaatcccatggtgctcattcaaaa
gaccgacaccggggtgtcgctccagacctatgatgacttgttagccaaag
actgccactgcata.

In a preferred embodiment, the second polypeptide chain comprises the amino acid sequence of SEQ ID NO:168, which is encoded by the nucleic acid sequence comprising the sequence of SEQ ID NO:172.

As discussed above, a tetramer is provided comprising two polypeptide chains comprising the sequence of SEQ ID NO:174 and two polypeptide chains comprising the sequence of SEQ ID NO:168.

II.H.18 Dh2CpmFc(−)(N297G)-GDF15(Ndel3):Dh2CpmFc(+)(N297G)

The designation "Dh2CpmFc(−)(N297G)-GDF15(Ndel3):Dh2CpmFc(+)(N297G)" in the instant disclosure refers to a heterodimer comprising (i) a first polypeptide chain comprising a GDF15(Ndel3) polypeptide, the N-terminus of which is linked directly to the C-terminus of a Dh2CpmFc(−)(N297G) domain, and (ii) a second polypeptide chain comprising a Dh2CpmFc(+)(N297G) domain.

In certain embodiments, a tetramer is provided, comprising a dimer of two Dh2CpmFc(−)(N297G)-GDF15(Ndel3):Dh2CpmFc(+)(N297G) heterodimers in which the two first polypeptide chains of each heterodimer are linked via an interchain disulfide bond between their respective GDF15 regions.

More particularly, in a specific embodiment, the tetramer comprises:
 (a) two Dh2CpmFc(+)(N297G) domains (one each heterodimer) comprising the sequence:

(SEQ ID NO: 295)
PSVFLFPPKPKDTLMISRTPEVTCVVVDVSHEDPEVKFNWYVDGVEVHNA
KTKPREEQYGSTYRVVSVLTVLHQDWLNGKEYKCKVSNKALPAPIEKTIS
KAKGQPREPQVYTLPPSRKEMTKNQVSLTCLVKGFYPSDIAVEWESNGQP
ENNYKTTPPVLKSDGSFFLYSKLTVDKSRWQQGNVFSCSVMHEALHNHYT
QKSLSLSPG, (b) two Dh2CpmFc(−)(N297G) domains (one each heterodimer) comprising the sequence:

(SEQ ID NO: 176)
PSVFLFPPKPKDTLMISRTPEVTCVVVDVSHEDPEVKFNWYVDGVEVHNA
KTKPREEQYGSTYRVVSVLTVLHQDWLNGKEYKCKVSNKALPAPIEKTIS
KAKGQPREPQVYTLPPSREEMTKNQVSLTCLVKGFYPSDIAVEWESNGQP
ENNYDTTPPVLDSDGSFFLYSDLTVDKSRWQQGNVFSCSVMHEALHNHYT
QKSLSLSPG, and
 (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 178)
PSVFLFPPKPKDTLMISRTPEVTCVVVDVSHEDPEVKFNWYVDGVEVHNA
KTKPREEQYGSTYRVVSVLTVLHQDWLNGKEYKCKVSNKALPAPIEKTIS
KAKGQPREPQVYTLPPSREEMTKNQVSLTCLVKGFYPSDIAVEWESNGQP
ENNYDTTPPVLDSDGSFFLYSDLTVDKSRWQQGNVFSCSVMHEALHNHYT
QKSLSLSPGGDHCPLGPGRCCRLHTVRASLEDLGWADWVLSPREVQVTMC
IGACPSQFRAANMHAQIKTSLHRLKPDTVPAPCCVPASYNPMVLIQKTDT
GVSLQTYDDLLAKDCHCI, which is encoded by the nucleic acid sequence:

(SEQ ID NO: 177)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacgggagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtacaccctgcccccatc ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtggagaccactgtccgctcgggcc cgggcgttgctgccgtctgcacacggtccgcgcgtcgctggaagacctgg gctgggccgattgggtgctgtcgccacgggaggtgcaagtgaccatgtgc atcggcgcgtgcccgagccagttccgggcggcaaacatgcacgcgcagat caagacgagcctgcaccgcctgaagcccgacacggtgccagcgccctgct gcgtgcccgccagctacaatcccatggtgctcattcaaaagaccgacacc ggggtgtcgctccagacctatgatgacttgttagccaaagactgccactg cata.

In a preferred embodiment, the second polypeptide chain comprises the amino acid sequence:

(SEQ ID NO: 175)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVYTLPPSRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPGK, which is encoded by the nucleic acid sequence:

(SEQ ID NO: 179)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacgggagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtacaccctgcccccatc ccggaaggagatgaccaagaaccaggtcagcctgacctgcctggtcaaag gcttctatcccagcgacatcgccgtggagtgggagagcaatgggcagccg gagaacaactacaagaccacgcctcccgtgctgaagtccgacggctcctt cttcctctatagcaagctcaccgtggacaagagcaggtggcagcagggga acgtcttctcatgctccgtgatgcatgaggctctgcacaaccactacacg cagaagagcctctccctgtctccgggtaaatga.

As discussed above, a tetramer is provided comprising two polypeptide chains comprising the sequence of SEQ ID NO:178 and two polypeptide chains comprising the sequence of SEQ ID NO:175.

II.H.19 Dh2CpmFc(−)(N297G)-GDF15(N3D):Dh2CpmFc(+)(N297G)

The designation "Dh2CpmFc(−)(N297G)-GDF15(N3D):DhCpmFc(+)(N297G)" in the instant disclosure refers to a heterodimer comprising (i) a first polypeptide chain comprising a GDF15(N3D) polypeptide, the N-terminus of which is linked directly to the C-terminus of a Dh2CpmFc(−)(N297G) domain, and (ii) a second polypeptide chain comprising a Dh2CpmFc(+)(N297G) domain.

In certain embodiments, a tetramer is provided, comprising a dimer of two Dh2CpmFc(−)(N297G)-GDF15(N3D):Dh2CpmFc(+)(N297G) heterodimers in which the two first polypeptide chains of each heterodimer are linked via an interchain disulfide bond between their respective GDF15 regions.

More particularly, in a specific embodiment, the tetramer comprises:

(a) two Dh2CpmFc(+)(N297G) domains (one each heterodimer) comprising the sequence of SEQ ID NO:295, (b) two Dh2CpmFc(−)(N297G) domains (one each heterodimer) comprising the sequence of SEQ ID NO:176, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 181)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVYTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI, which is encoded by the nucleic acid sequence:

(SEQ ID NO: 180)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacgggagcacgtaccgtgtggtcag cgtcctcaccgtcctgcaccaggactggctgaatggcaaggagtacaagt gcaaggtctccaacaaagccctcccagcccccatcgagaaaaccatctcc aaagccaaagggcagccccgagaaccacaggtgtacaccctgcccccatc

```
ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtgcgcgcgacggagaccactgtcc gctcgggcccgggcgttgctgccgtctgcacacggtccgcgcgtcgctgg aagacctgggctgggccgattgggtgctgtcgccacgggaggtgcaagtg accatgtgcatcggcgcgtgcccgagccagttccgggcggcaaacatgca cgcgcagatcaagacgagcctgcaccgcctgaagcccgacacggtgccag cgccctgctgcgtgcccgccagctacaatcccatggtgctcattcaaaag accgacaccggggtgtcgctccagacctatgatgacttgttagccaaaga ctgccactgcata.
```

In a preferred embodiment, the second polypeptide chain comprises the amino acid sequence of SEQ ID NO:175, which is encoded by the nucleic acid sequence of SEQ ID NO:179.

As discussed above, a tetramer is provided comprising two polypeptide chains comprising the sequence of SEQ ID NO:181 and two polypeptide chains comprising the sequence of SEQ ID NO:175.

II.H.20 Dh2CpmFc(−)(N297G)(Y349C)-GDF15(Ndel3): Dh2CpmFc(+)(N297G)(S354C)

The designation "Dh2CpmFc(−)(N297G)(Y349C)- GDF15(Ndel3):Dh2CpmFc(+)(N297G)(S354C)" in the instant disclosure refers to a heterodimer comprising (i) a first polypeptide chain comprising a GDF15(Ndel3) polypeptide, the N-terminus of which is linked directly to the C-terminus of a Dh2CpmFc(−)(N297G)(Y349C) polypeptide, and (ii) a second polypeptide chain comprising a Dh2CpmFc(+)(N297G)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two Dh2CpmFc(−)(N297G)(Y349C)-GDF15 (Ndel3):Dh2CpmFc(+)(N297G)(S354C) heterodimers in which the two first polypeptide chains of each heterodimer are linked via an interchain disulfide bond between their respective GDF15 regions.

More particularly, in a specific embodiment, the tetramer comprises:

(a) two Dh2CpmFc(+)(N297G)(S354C) domains (one each heterodimer) comprising the sequence:

(SEQ ID NO: 296)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPG, (b) two Dh2CpmFc(−)(N297G)(Y349C) domains (one each heterodimer) comprising the sequence:

(SEQ ID NO: 183)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 185)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGGDHCPLGPGRCCRLHTVRASLEDLGWADWVLSPREVQVTMC

IGACPSQFRAANMHAQIKTSLHRLKPDTVPAPCCVPASYNPMVLIQKTDT

GVSLQTYDDLLAKDCHCI, which is encoded by the nucleic acid sequence:

```
(SEQ ID NO: 184)
ccgtcagtcttcctcttccccccaaaacccaaggacaccctcatgatctc ccggacccctgaggtcacatgcgtggtggtggacgtgagccacgaagacc ctgaggtcaagttcaactggtacgtggacggcgtggaggtgcataatgcc aagacaaagccgcgggaggagcagtacggcagcacgtaccgtgtggtcag cgtcctcaccgtcctgcaccaggactggctgaatggcaaggagtacaagt gcaaggtctccaacaaagccctcccagccccatcgagaaaaccatctcc aaagccaaagggcagccccgagaaccacaggtgtgcaccctgcccccatc ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtggagaccactgtccgctcgggcc cgggcgttgctgccgtctgcacacggtccgcgcgtcgctggaagacctgg gctgggccgattgggtgctgtcgccacgggaggtgcaagtgaccatgtgc atcggcgcgtgcccgagccagttccgggcggcaaacatgcacgcgcagat caagacgagcctgcaccgcctgaagcccgacacggtgccagcgccctgct gcgtgcccgccagctacaatcccatggtgctcattcaaaagaccgacacc ggggtgtcgctccagacctatgatgacttgttagccaaagactgccactg cata.
```

In a preferred embodiment, the second polypeptide chain comprises the amino acid sequence:

(SEQ ID NO: 182)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPGK, which is encoded by the nucleic acid sequence:

(SEQ ID NO: 186)
ccatccgtgttcctgtttcctccaaagccgaaggacaccctgatgatctc aagaactccggaagtgacttgcgtcgtcgtggacgtgtcacatgaggatc cagaggtcaagttcaattggtatgtggacggagtggaagtgcataacgcc aagaccaaacccgcgaagaacagtacgggagcacctaccgcgtggtgag cgtccttactgtgctccaccaggactggcttaatgggaaggaatacaagt gtaaggtgtccaacaaggccctccccgctcccatcgaaaagaccatctca aaggcaaaggggcaaccaagggaacctcaagtgtacaccctgcctccgtg caggaaggagatgaccaagaaccaggtcagcctgacttgtctcgtgaagg gcttctatcccagcgatattgctgtggaatgggagtcaaatggccagccc gagaataactacaaaactaccccaccgtgctgaaatctgatggtcctt cttcctttactccaagctgaccgtggacaagagccgctggcaacaaggca atgtctttagctgctcagtgatgcatgaggctctccataatcactacact cagaagtcactgtcctgtctccgggtaaa.

As discussed above, a tetramer is provided comprising two polypeptide chains comprising the sequence of SEQ ID NO:185 and two polypeptide chains comprising the sequence of SEQ ID NO:182.

II.H.21 Dh2CpmFc(-)(N297G)(Y349C)-GDF15(N3D):Dh2CpmFc(+)(N297G)(S354C)

The designation "Dh2CpmFc(-)(N297G)(Y349C)-GDF15(N3D):Dh2CpmFc(+)(N297G)(S354C)" in the instant disclosure refers to a heterodimer comprising (i) a first polypeptide chain comprising a GDF15(N3D) polypeptide, the N-terminus of which is linked directly to the C-terminus of a Dh2CpmFc(-)(N297G)(Y349C) domain, and (ii) a second polypeptide chain comprising a Dh2CpmFc(+)(N297G)(S345C) domain The cysteine clamp mutations allow the first and second polypeptide chains to be linked via an interchain disulfide bond between C349 of the first polypeptide and C354 of the second polypeptide.

In certain embodiments, a tetramer is provided, comprising a dimer of two Dh2CpmFc(-)(N297G)(Y349C)-GDF15(N3D):Dh2CpmFc(+)(N297G)(S354C) heterodimers in which the two first polypeptide chains of each heterodimer are linked via an interchain disulfide bond between their respective GDF15 regions.

More particularly, in a specific embodiment, the tetramer comprises:

(a) two Dh2CpmFc(+)(N297G)(S354C) domains (one each heterodimer) comprising the sequence of SEQ ID NO:296, (b) two Dh2CpmFc(-)(N297G)(Y349C) domains (one each heterodimer) comprising the sequence of SEQ ID NO:183, and (c) two GDF15(N3D) polypeptide (one each heterodimer) comprising the sequence of SEQ ID NO:52.

In a preferred embodiment, the first polypeptide chain comprises the amino acid sequence:

(SEQ ID NO: 188)
PSVFLFPPKPKDTLMISRTPEVTCVVVDVSHEDPEVKFNWYVDGVEVHNA

KTKPREEQYGSTYRVVSVLTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI, which is encoded by the nucleic acid sequence:

(SEQ ID NO: 187)
ccgtcagtcttcctcttccccccaaaacccaaggacaccctcatgatctc ccggaccctgaggtcacatgcgtggtggtggacgtgagccacgaagacc ctgaggtcaagttcaactggtacgtggacggcgtggaggtgcataatgcc aagacaaagccgcgggaggagcagtacgggagcacgtaccgtgtggtcag cgtcctcaccgtcctgcaccaggactggctgaatggcaaggagtacaagt gcaaggtctccaacaaagcctcccagccccatcgagaaaaccatctcc aaagccaaagggcagccccgagaaccacaggtgtgcaccctgcccccatc ccgggaggagatgaccaagaaccaggtcagcctgacctgcctggtcaaag gcttctatcccagcgacatcgccgtggagtgggagagcaatgggcagccg gagaacaactacgacaccacgcctcccgtgctggactccgacggctcctt cttcctctatagcgacctcaccgtggacaagagcaggtggcagcagggga acgtcttctcatgctccgtgatgcatgaggctctgcacaaccactacacg cagaagagcctctccctgtctccgggtgcgcgcgacggagaccactgtcc gctcgggcccgggcgttgctgccgtctgcacacggtccgcgcgtcgctgg aagacctgggctgggccgattgggtgctgtcgccacgggaggtgcaagtg accatgtgcatcggcgcgtgcccgagccagttccgggcggcaaacatgca cgcgcagatcaagacgagcctgcaccgcctgaagcccgacacggtgccag cgccctgctgcgtgcccgccagctacaatcccatggtgctcattcaaaag accgacaccggggtgtcgctccagacctatgatgacttgttagccaaaga ctgccactgcata.

In a preferred embodiment, the second polypeptide chain comprises the amino acid sequence of SEQ ID NO:182, which is encoded by the nucleic acid sequence of SEQ ID NO:186.

As discussed above, a tetramer is provided comprising two polypeptide chains comprising the sequence of SEQ ID NO:188 and two polypeptide chains comprising the sequence of SEQ ID NO:182.

II.H.22 Dh2CpmFc(-)(N297G)(A287C)-GDF15(Ndel3):Dh2CpmFc(+)(N297G)(L306C)

The designation "Dh2CpmFc(-)(N297G)(A287C)-GDF15(Ndel3):Dh2CpmFc(+)(N297G)(L306C)" in the instant disclosure refers to a heterodimer comprising (i) a first polypeptide chain comprising GDF15(Ndel3) polypeptide, the N-terminus of which is linked directly to the C-terminus of a Dh2CpmFc(−)(N297G)(A287C) domain, and (ii) a second polypeptide chain comprising a Dh2CpmFc(+)(N297G)(L306C) domain. The cysteine clamp mutations allow the first and second polypeptide chains to be linked via an interchain disulfide bond between C287 of the first monomer and C306 of the second monomer.

In certain embodiments, a tetramer is provided, comprising a dimer of two Dh2CpmFc(−)(N297G)(A287C)-GDF15(Ndel3):Dh2CpmFc(+)(N297G)(L306C) heterodimers in which the two first polypeptide chains of each heterodimer are linked via an interchain disulfide bond between their respective GDF15 regions.

More particularly, in a specific embodiment, a tetramer is provided which comprises:

(a) two Dh2CpmFc(+)(N297G)(L306C) domains (one each heterodimer) comprising the sequence:

(SEQ ID NO: 297)
PSVFLFPPKPKDTLMISRTPEVTCVVVDVSHEDPEVKFNWYVDGVEVHNC
KTKPREEQYGSTYRVVSVCTVLHQDWLNGKEYKCKVSNKALPAPIEKTIS
KAKGQPREPQVYTLPPSRKEMTKNQVSLTCLVKGFYPSDIAVEWESNGQP
ENNYKTTPPVLKSDGSFFLYSKLTVDKSRWQQGNVFSCSVMHEALHNHYT
QKSLSLSPG, (b) two Dh2CpmFc(−)(N297G)(A287C) (one each heterodimer) comprising the sequence:

(SEQ ID NO: 192)
PSVFLFPPKPKDTLMISRTPEVTCVVVDVSHEDPEVKFNWYVDGVEVHNC
KTKPREEQYGSTYRVVSVCTVLHQDWLNGKEYKCKVSNKALPAPIEKTIS
KAKGQPREPQVYTLPPSREEMTKNQVSLTCLVKGFYPSDIAVEWESNGQP
ENNYDTTPPVLDSDGSFFLYSDLTVDKSRWQQGNVFSCSVMHEALHNHYT
QKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 194)
PSVFLFPPKPKDTLMISRTPEVTCVVVDVSHEDPEVKFNWYVDGVEVHNC
KTKPREEQYGSTYRVVSVCTVLHQDWLNGKEYKCKVSNKALPAPIEKTIS
KAKGQPREPQVYTLPPSREEMTKNQVSLTCLVKGFYPSDIAVEWESNGQP
ENNYDTTPPVLDSDGSFFLYSDLTVDKSRWQQGNVFSCSVMHEALHNHYT
QKSLSLSPGGDHCPLGPGRCCRLHTVRASLEDLGWADWVLSPREVQVTMC
IGACPSQFRAANMHAQIKTSLHRLKPDTVPAPCCVPASYNPMVLIQKTDT
GVSLQTYDDLLAKDCHCI, which is encoded by the nucleic acid sequence:

(SEQ ID NO: 193)
ccgtcagtcttcctcttccccaaaacccaaggacaccctca
tgatctcccggaccctgaggtcacatgcgtggtggtggacgtgagccac
gaagaccctgaggtcaagttcaactggtacgtggacggcgtggaggtgca
taattgcaagacaaagccgcgggaggagcagtacggcagcacgtaccgtg
tggtcagcgtctgcaccgtcctgcaccaggactggctgaatggcaaggag
tacaagtgcaaggtctccaacaaagccctcccagcccccatcgagaaaac
catctccaaagccaaagggcagccccgagaaccacaggtgtacaccctgc
ccccatcccgggaggagatgaccaagaaccaggtcagcctgacctgcctg
gtcaaaggcttctatcccagcgacatcgccgtggagtgggagagcaatgg
gcagccggagaacaactacgacaccacgcctcccgtgctggactccgacg
gctccttcttcctctatagcgacctcaccgtggacaagagcaggtggcag
caggggaacgtcttctcatgctccgtgatgcatgaggctctgcacaacca
ctacacgcagaagagcctctccctgtctccgggtggagaccactgtccgc
tcgggcccgggcgttgctgccgtctgcacacggtccgcgcgtcgctggaa
gacctgggctgggccgattgggtgctgtcgccacgggaggtgcaagtgac
catgtgcatcggcgcgtgcccgagccagttccgggcggcaaacatgcacg
cgcagatcaagacgagcctgcaccgcctgaagcccgacacggtgccagcg
ccctgctgcgtgcccgccagctacaatcccatggtgctcattcaaaagac
cgacaccggggtgtcgctccagacctatgatgacttgttagccaaagact
gccactgcata.

In a preferred embodiment, the second polypeptide chain comprises the amino acid sequence:

(SEQ ID NO: 191)
PSVFLFPPKPKDTLMISRTPEVTCVVVDVSHEDPEVKFNWYVDGVEVHNC
KTKPREEQYGSTYRVVSVCTVLHQDWLNGKEYKCKVSNKALPAPIEKTIS
KAKGQPREPQVYTLPPSRKEMTKNQVSLTCLVKGFYPSDIAVEWESNGQP
ENNYKTTPPVLKSDGSFFLYSKLTVDKSRWQQGNVFSCSVMHEALHNHYT
QKSLSLSPGK, which is encoded by the nucleic acid sequence:

(SEQ ID NO: 195)
ccgtcagtcttcctcttccccaaaacccaaggacaccctca
tgatctcccggaccctgaggtcacatgcgtggtggtggacgtgagccac
gaagaccctgaggtcaagttcaactggtacgtggacggcgtggaggtgca
taattgcaagacaaagccgcgggaggagcagtacggcagcacgtaccgtg
tggtcagcgtctgcaccgtcctgcaccaggactggctgaatggcaaggag
tacaagtgcaaggtctccaacaaagccctcccagcccccatcgagaaaac
catctccaaagccaaagggcagccccgagaaccacaggtgtacaccctgc
ccccatcccggaaggagatgaccaagaaccaggtcagcctgacctgcctg
gtcaaaggcttctatcccagcgacatcgccgtggagtgggagagcaatgg
gcagccggagaacaactacaagaccacgcctcccgtgctgaagtccgacg
gctccttcttcctctatagcaagctcaccgtggacaagagcaggtggcag
caggggaacgtcttctcatgctccgtgatgcatgaggctctgcacaacca
ctacacgcagaagagcctctccctgtctccgggtaaa.

As discussed above, a tetramer is provided comprising two polypeptide chains comprising the sequence of SEQ ID NO:194 and two polypeptide chains comprising the sequence of SEQ ID NO:191.

II.H.23 Dh2CpmFc(-)(N297G)(A287C)-GDF15(N3D): Dh2CpmFc(+)(N297G)(L306C)

The designation "Dh2CpmFc(-)(N297G)(A287C)-GDF15(N3D):Dh2CpmFc(+)(N297G)(L306C)" in the instant disclosure refers to a heterodimer comprising (i) a first polypeptide chain comprising a GDF15(N3D) polypeptide, the N-terminus of which is linked directly to the C-terminus of a Dh2CpmFc(-)(N297G)(A287C) domain, and (ii) a second polypeptide chain comprising a Dh2CpmFc(+)(N297G)(L306C) domain. The cysteine clamp mutations allow the first and second polypeptide chains to be linked via an interchain disulfide bond between C287 of the first polypeptide chain and C306 of the second polypeptide chain.

In certain embodiments, a tetramer is provided, comprising a dimer of two Dh2CpmFc(-)(N297G)(A287C)-GDF15(N3D):Dh2CpmFc(+)(N297G)(L306C) heterodimers in which the two first polypeptide chains of each heterodimer are linked via an interchain disulfide bond between their respective GDF15 regions.

More particularly, in a specific embodiment, a tetramer is provided which comprises:

(a) two Dh2CpmFc(+)(N297G)(L306C) domains (one each heterodimer) comprising the sequence of SEQ ID NO:297, (b) two Dh2CpmFc(-)(N297G)(A287C) domains (one each heterodimer) comprising the sequence of SEQ ID NO:192, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 197)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVYTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI, which is encoded by the nucleic acid sequence:

(SEQ ID NO: 196)
ccgtcagtcttcctcttcccccaaaacccaaggacaccctca tgatctcccggaccctgaggtcacatgcgtggtggtggacgtgagccac gaagaccctgaggtcaagttcaactggtacgtggacggcgtggaggtgca taattgcaagacaaagccgcgggaggagcagtacggcagcacgtaccgtg tggtcagcgtctgcaccgtcctgcaccaggactggctgaatggcaaggag tacaagtgcaaggtctccaacaaagccctcccagcccccatcgagaaaac catctccaaagccaaagggcagccccgagaaccacaggtgtacaccctgc ccccatcccgggaggagatgaccaagaaccaggtcagcctgacctgcctg gtcaaaggcttctatcccagcgacatcgccgtggagtgggagagcaatgg gcagccggagaacaactacgacaccacgcctcccgtgctggactccgacg gctccttcttcctctatagcgacctcaccgtggacaagagcaggtggcag caggggaacgtcttctcatgctccgtgatgcatgaggctctgcacaacca ctacacgcagaagagcctctccctgtctccgggtgcgcgcgacggagacc actgtccgctcgggccgggcgttgctgccgtctgcacacggtccgcgcg tcgctggaagacctgggctgggccgattgggtgctgtcgccacgggaggt gcaagtgaccatgtgcatcggcgcgtgcccgagccagttccgggcggcaa acatgcacgcgcagatcaagacgagcctgcaccgcctgaagcccgacacg gtgccagcgccctgctgcgtgcccgccagctacaatcccatggtgctcat tcaaaagaccgacaccggggtgtcgctccagacctatgatgacttgttag ccaaagactgccactgcata.

In a preferred embodiment, the second polypeptide chain comprises the amino acid sequence of SEQ ID NO:191, which is encoded by the nucleic acid sequence of SEQ ID NO:195.

As discussed above, a tetramer is provided comprising two polypeptide chains comprising the sequence of SEQ ID NO:197 and two polypeptide chains comprising the sequence of SEQ ID NO:191.

II.H.24 Dh2CpmFc(-)(N297G)(A287C)(Y349C)-GDF15(Ndel3):Dh2CpmFc(+)(N297G)(L306C)(S354C)

The designation "Dh2CpmFc(-)(N297G)(A287C)(Y349C)-GDF15(Ndel3):Dh2CpmFc(+)(N297G)(L306C)(S 354C)" in the instant disclosure refers to a heterodimer comprising (i) a first polypeptide chain comprising GDF15(Ndel3) polypeptide, the N-terminus of which is linked directly to the C-terminus of a Dh2CpmFc(-)(N297G)(A287C)(Y349C) domain, and (ii) a second polypeptide chain comprising a Dh2CpmFc(+)(N297G)(L306C)(S354C) domain. The cysteine clamp mutations allow the first and second polypeptide chains to be linked via an interchain disulfide bond between C287 of the first polypeptide chain and C306 of the second polypeptide chain and between the C349 of the first polypeptide chain and C349 of the second polypeptide chain.

In certain embodiments, a tetramer is provided, comprising a dimer of two Dh2CpmFc(-)(N297G)(A287C)(Y349C)-GDF15(Ndel3):Dh2CpmFc(+)(N297G)(L306C)(S354C) heterodimers in which the two first polypeptide chains of each heterodimer are linked via an interchain disulfide bond between their respective GDF15 regions.

More particularly, in a specific embodiment, a tetramer is provided which comprises:

(a) two Dh2CpmFc(+)(N297G)(L306C)(S354C) domains (one each heterodimer) comprising the sequence:

(SEQ ID NO: 298)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPG, (b) two Dh2CpmFc(−)(N297G)(A287C)(Y349C) domains (one each heterodimer) comprising the sequence:

(SEQ ID NO: 199)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 201)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGGDHCPLGPGRCCRLHTVRASLEDLGWADWVLSPREVQVTMC

IGACPSQFRAANMHAQIKTSLHRLKPDTVPAPCCVPASYNPMVLIQKTDT

GVSLQTYDDLLAKDCHCI, which is encoded by the nucleic acid sequence:

(SEQ ID NO: 200)
ccgtcagtcttcctcttccccccaaaacccaaggacaccctca tgatctcccggacccctgaggtcacatgcgtggtggtggacgtgagccac gaagaccctgaggtcaagttcaactggtacgtggacggcgtggaggtgca taattgcaagacaaagccgcgggaggagcagtacggcagcacgtaccgtg tggtcagcgtctgcaccgtcctgcaccaggactggctgaatggcaaggag tacaagtgcaaggtctccaacaaagccctcccagccccatcgagaaaac catctccaaagccaaagggcagccccgagaaccacaggtgtgcaccctgc ccccatcccggaggagatgaccaagaaccaggtcagcctgacctgcctg gtcaaaggcttctatcccagcgacatcgccgtggagtgggagagcaatgg gcagccggagaacaactacgacaccacgcctcccgtgctggactccgacg gctccttcttcctctatagcgacctcaccgtggacaagagcaggtggcag caggggaacgtcttctcatgctccgtgatgcatgaggctctgcacaacca ctacacgcagaagagcctctccctgtctccgggtggagaccactgtccgc tcgggcccgggcgttgctgccgtctgcacacggtccgcgcgtcgctggaa gacctgggctgggccgattgggtgctgtcgccacgggaggtgcaagtgac catgtgcatcggcgcgtgcccgagccagttccgggcggcaaacatgcacg cgcagatcaagacgagcctgcaccgcctgaagcccgacacggtgccagcg ccctgctgcgtgcccgccagctacaatcccatggtgctcattcaaaagac cgacaccggggtgtcgctccagacctatgatgacttgttagccaaagact gccactgcata.

In a preferred embodiment, the second polypeptide chain comprises the amino acid sequence:

(SEQ ID NO: 198)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVYTLPPCRKEMTKNQVSLTCLVKGFYPSDIAVEWESNGQP

ENNYKTTPPVLKSDGSFFLYSKLTVDKSRWQQGNVFSCSVMHEALHNHYT

QKSLSLSPGK, which is encoded by the nucleic acid sequence:

(SEQ ID NO: 202)
ccgtcagtcttcctcttccccccaaaacccaaggacaccctca tgatctcccggacccctgaggtcacatgcgtggtggtggacgtgagccac gaagaccctgaggtcaagttcaactggtacgtggacggcgtggaggtgca taattgcaagacaaagccgcgggaggagcagtacggcagcacgtaccgtg tggtcagcgtctgcaccgtcctgcaccaggactggctgaatggcaaggag tacaagtgcaaggtctccaacaaagccctcccagccccatcgagaaaac catctccaaagccaaagggcagccccgagaaccacaggtgtacaccctgc ccccatgccggaaggagatgaccaagaaccaggtcagcctgacctgcctg gtcaaaggcttctatcccagcgacatcgccgtggagtgggagagcaatgg gcagccggagaacaactacaagaccacgcctcccgtgctgaagtccgacg gctccttcttcctctatagcaagctcaccgtggacaagagcaggtggcag caggggaacgtcttctcatgctccgtgatgcatgaggctctgcacaacca ctacacgcagaagagcctctccctgtctccgggtaaa.

As discussed above, a tetramer is provided comprising two polypeptide chains comprising the sequence of SEQ ID NO:201 and two polypeptide chains comprising the sequence of SEQ ID NO:198.

II.H.25 Dh2CpmFc(−)(N297G)(A287C)(Y349C)-GDF15(N3D):Dh2CpmFc(+)(N297G)(L306C)(S354C)

The designation "Dh2CpmFc(−)(N297G)(A287C)(Y349C)-GDF15(N3D):Dh2CpmFc(+)(N297G)(L306C)(S354C)" in the instant disclosure refers to a heterodimer comprising (i) a first monomer comprising GDF15(N3D) polypeptide, the N-terminus of which is linked directly to the C-terminus of a Dh2CpmFc(−)(N297G)(A287C)(Y349C) domain, and (ii) a second polypeptide chain comprising a Dh2CpmFc(+)(N297G)(L306C)(S354C) domain. The cysteine clamp mutations allow the first and second polypeptide chains to be linked via an interchain disulfide bond between C287 of the first polypeptide chain and C306 of the second polypeptide chain and between the C349 of the first polypeptide chain and C349 of the second polypeptide chain.

In certain embodiments, a tetramer is provided, comprising a dimer of two Dh2CpmFc(−)(N297G)(A287C)(Y349C)-GDF15(N3D):Dh2CpmFc(+)(N297G)(L306C)(S354C) heterodimers in which the two first polypeptide chains of each heterodimer are linked via an interchain disulfide bond between their respective GDF15 regions.

More particularly, in a specific embodiment, a tetramer is provided which comprises:

(a) two Dh2CpmFc(+)(N297G)(L306C)(S354C) domains (one each heterodimer) comprising the sequence of SEQ ID NO:298, (b) two Dh2CpmFc(−)(N297G)(A287C)(Y349C) domains (one each heterodimer) comprising the sequence of SEQ ID NO:199, and (c) two GDF15(N3D) polypeptides (one each heterodimer) comprising the sequence of (SEQ ID NO:52).

In a preferred embodiment, the first polypeptide chain comprises the amino acid sequence:

```
                                          (SEQ ID NO: 204)
PSVFLFPPKPKDTLMISRTPEVTCVVVDVSHEDPEVKFNWYVDGVEVHNC

KTKPREEQYGSTYRVVSVCTVLHQDWLNGKEYKCKVSNKALPAPIEKTIS

KAKGQPREPQVCTLPPSREEMTKNQVSLTCLVKGFYPSDIAVEWESNGQP

ENNYDTTPPVLDSDGSFFLYSDLTVDKSRWQQGNVFSCSVMHEALHNHYT

QKSLSLSPGARDGDHCPLGPGRCCRLHTVRASLEDLGWADWVLSPREVQV

TMCIGACPSQFRAANMHAQIKTSLHRLKPDTVPAPCCVPASYNPMVLIQK

TDTGVSLQTYDDLLAKDCHCI,
``` which is encoded by the nucleic acid sequence:

```
                                          (SEQ ID NO: 203)
ccgtcagtcttcctcttcccccaaaacccaaggacaccctca tgatctcccggacccctgaggtcacatgcgtggtggtggacgtgagccac gaagaccctgaggtcaagttcaactggtacgtggacggcgtggaggtgca taattgcaagacaaagccgcgggaggagcagtacggcagcacgtaccgtg tggtcagcgtctgcaccgtcctgcaccaggactggctgaatggcaaggag tacaagtgcaaggtctccaacaaagccctcccagcccccatcgagaaaac catctccaaagccaaagggcagccccgagaaccacaggtgtgcaccctgc ccccatcccgggaggagatgaccaagaaccaggtcagcctgacctgcctg gtcaaaggcttctatcccagcgacatcgccgtggagtgggagagcaatgg gcagccggagaacaactacgacaccacgcctcccgtgctggactccgacg gctccttcttcctctatagcgacctcaccgtggacaagagcaggtggcag caggggaacgtcttctcatgctccgtgatgcatgaggctctgcacaacca ctacacgcagaagagcctctccctgtctccgggtgcgcgcgacggagacc actgtccgctcgggcccgggcgttgctgccgtctgcacacggtccgcgcg tcgctggaagacctgggctgggccgattgggtgctgtcgccacgggaggt gcaagtgaccatgtgcatcggcgcgtgcccgagccagttccgggcggcaa acatgcacgcgcagatcaagacgagcctgcaccgcctgaagcccgacacg gtgccagcgccctgctgcgtgcccgccagctacaatcccatggtgctcat tcaaaagaccgacaccggggtgtcgctccagacctatgatgacttgttag ccaaagactgccactgcata.
```

In a preferred embodiment, the second polypeptide chain comprises the amino acid sequence of SEQ ID NO:198, which is encoded by the nucleic acid sequence of SEQ ID NO:202.

As discussed above, a tetramer is provided comprising two polypeptide chains comprising the sequence of SEQ ID NO:204 and two polypeptide chains comprising the sequence of SEQ ID NO:198.

II.H.26 GG-Dh2CpmFc(−)-GDF15(Ndel3):GG-Dh2CpmFc(+)

The designation "GG-Dh2CpmFc(−)-GDF15(Ndel3): GG-Dh2CpmFc(+)" in the instant disclosure refers to a heterodimer comprising (i) a first polypeptide chain comprising a GDF15(Ndel3) polypeptide, the N-terminus of which is linked directly to the C-terminus of a GG-Dh2CpmFc(−) domain, and (ii) a second polypeptide chain comprising a GG-Dh2CpmFc(+) domain.

In certain embodiments, a tetramer is provided, comprising a dimer of two GG-Dh2CpmFc(−)-GDF15(Ndel3):GG-Dh2CpmFc(+) heterodimers in which the two first polypeptide chains of each heterodimer are linked via an interchain disulfide bond between their respective GDF15 regions.

More particularly, in a specific embodiment, the tetramer comprises:

(a) two GG-Dh2CpmFc(+) domains (one each heterodimer) comprising the sequence:

```
                                          (SEQ ID NO: 299)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSRKEMTKNQVSLTCLVKGFYPSDIAVEWESNG

QPENNYKTTPPVLKSDGSFFLYSKLTVDKSRWQQGNVFSCSVMHEALHNH

YTQKSLSLSPG,
```

(b) two GG-Dh2CpmFc(−) domains (one each heterodimer) comprising the sequence:

```
                                          (SEQ ID NO: 206)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPG,
``` and (c) two GDF15(Ndel3) polypeptides (one each heterodimer) comprising the sequence of SEQ ID NO:55.

In a preferred embodiment, the first polypeptide chain comprises the amino acid sequence:

```
                                          (SEQ ID NO: 208)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPGGDHCPLGPGRCCRLHTVRASLEDLGWADWVLSPREVQVT

MCIGACPSQFRAANMHAQIKTSLHRLKPDTVPAPCCVPASYNPMVLIQKT

DTGVSLQTYDDLLAKDCHCI,
``` which is encoded by the nucleic acid sequence:

```
                                          (SEQ ID NO: 207)
ggtggcccgtcagtcttcctcttcccccaaaacccaaggaca ccctcatgatctcccggaccccctgaggtcacatgcgtggtggtggacgtg
```

-continued
agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtggagaccact gtccgctcgggcccgggcgttgctgccgtctgcacacggtccgcgcgtcg ctggaagacctgggctggccgattgggtgctgtcgccacgggaggtgca agtgaccatgtgcatcggcgcgtgcccgagccagttccgggcggcaaaca tgcacgcgcagatcaagacgagcctgcaccgcctgaagcccgacacggtg ccagcgccctgctgcgtgcccgccagctacaatcccatggtgctcattca aaagaccgacaccggggtgtcgctccagacctatgatgacttgttagcca aagactgccactgcata.

In an embodiment employing the VH21 signal sequence, in a preferred embodiment, the first polypeptide chain comprises the amino acid sequence (signal sequence single underlined):

(SEQ ID NO: 243)
<u>MEWSWVFLFFLSVTTGVHS</u>GGPSVFLFPPKPKDTLMISRTPEVTCVVVDV

SHEDPEVKFNWYVDGVEVHNAKTKPREEQYNSTYRVVSVLTVLHQDWLNG

KEYKCKVSNKALPAPIEKTISKAKGQPREPQVYTLPPSREEMTKNQVSLT

CLVKGFYPSDIAVEWESNGQPENNYDTTPPVLDSDGSFFLYSDLTVDKSR

WQQGNVFSCSVMHEALHNHYTQKSLSLSPGGDHCPLGPGRCCRLHTVRAS

LEDLGWADWVLSPREVQVTMCIGACPSQFRAANMHAQIKTSLHRLKPDTV

PAPCCVPASYNPMVLIQKTDTGVSLQTYDDLLAKDCHCI, which is encoded by the nucleic acid sequence (signal sequence underlined):

(SEQ ID NO: 244)
<u>atggaatggagctggtctttctcttcttcctgtcagtaacgactggtgt</u>

<u>ccactccggt</u>ggcccgtcagtcttcctcttcccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtggagaccact gtccgctcgggcccgggcgttgctgccgtctgcacacggtccgcgcgtcg ctggaagacctgggctggccgattgggtgctgtcgccacgggaggtgca agtgaccatgtgcatcggcgcgtgcccgagccagttccgggcggcaaaca tgcacgcgcagatcaagacgagcctgcaccgcctgaagcccgacacggtg ccagcgccctgctgcgtgcccgccagctacaatcccatggtgctcattca aaagaccgacaccggggtgtcgctccagacctatgatgacttgttagcca aagactgccactgcata.

In a preferred embodiment, the second polypeptide chain comprises the amino acid sequence:

(SEQ ID NO: 205)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSRKEMTKNQVSLTCLVKGFYPSDIAVEWESNG

QPENNYKTTPPVLKSDGSFFLYSKLTVDKSRWQQGNVFSCSVMHEALHNH

YTQKSLSLSPGK, which is encoded by the nucleic acid sequence:

(SEQ ID NO: 209)
ggtggcccgtcagtcttcctcttcccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatcccgggaggagatgaccaagaaccaggtcagcctgacc tgcctggtcaaaggcttctatcccagcgacatcgccgtggagtgggagag caatgggcagccggagaacaactacaagaccacgcctcccgtgctgaagt ccgacggctccttcttcctctatagcaagctcaccgtggacaagagcagg tggcagcaggggaacgtcttctcatgctccgtgatgcatgaggctctgca caaccactacacgcagaagagcctctccctgtctccgggtaaa.

In an embodiment employing the VH21 signal sequence, in a preferred embodiment, the second polypeptide chain comprises the amino acid sequence (signal sequence single underlined):

(SEQ ID NO: 245)
<u>MEWSWVFLFFLSVTTGVHS</u>GGPSVFLFPPKPKDTLMISRTPEVTCVVVDV

SHEDPEVKFNWYVDGVEVHNAKTKPREEQYNSTYRVVSVLTVLHQDWLNG

-continued

KEYKCKVSNKALPAPIEKTISKAKGQPREPQVYTLPPSRKEMTKNQVSLT

CLVKGFYPSDIAVEWESNGQPENNYKTTPPVLKSDGSFFLYSKLTVDKSR

WQQGNVFSCSVMHEALHNHYTQKSLSLSPGK, which is encoded by the nucleic acid sequence (signal sequence underlined):

(SEQ ID NO: 246)
atggaatggagctgggtctttctcttcttcctgtcagtaacgactggtgt ccactccggtggcccgtcagtcttcctcttcccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagccccatcga gaaaaccatctccaaagccaaagggcagccccgagaaccacaggtgtaca ccctgcccccatcccggaaggagatgaccaagaaccaggtcagcctgacc tgcctggtcaaaggcttctatcccagcgacatcgccgtggagtgggagag caatgggcagccggagaacaactacaagaccacgcctcccgtgctgaagt ccgacggctccttcttcctctatagcaagctcaccgtggacaagagcagg tggcagcaggggaacgtcttctcatgctccgtgatgcatgaggctctgca caaccactacacgcagaagagcctctccctgtctccgggtaaa.

As discussed above, a tetramer is provided comprising two polypeptide chains comprising the sequence of SEQ ID NO:208 and two polypeptide chains comprising the sequence of SEQ ID NO:205.

II.H.27 GG-Dh2CpmFc(−)-GDF15(N3D):GG-Dh2CpmFc(+)

The designation "GG-Dh2CpmFc(−)-GDF15(N3D):GG-DhCpmFc(+)" in the instant disclosure refers to a heterodimer comprising (i) a first polypeptide chain comprising a GDF15(N3D) polypeptide, the N-terminus of which is linked directly to the C-terminus of a GG-Dh2CpmFc(−) domain, and (ii) a second polypeptide chain comprising a GG-DhCpmFc(+) domain.

In certain embodiments, a tetramer is provided, comprising a dimer of two GG-Dh2CpmFc(−)-GDF15(N3D):GG-Dh2CpmFc(+) heterodimers in which the two first polypeptide chains of each heterodimer are linked via an interchain disulfide bond between their respective GDF15 regions.

More particularly, in a specific embodiment, the tetramer comprises:

(a) two GG-Dh2CpmFc(+) domains (one each heterodimer) comprising the sequence of SEQ ID NO:299, (b) two GG-Dh2CpmFc(−) domains (one each heterodimer) comprising the sequence of SEQ ID NO:206, and (c) two GDF15(N3D) polypeptides (one each heterodimer) comprising the sequence of SEQ ID NO:52.

In a preferred embodiment, the first polypeptide chain comprises the amino acid sequence:

(SEQ ID NO: 211)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPGARDGDHCPLGPGRCCRLHTVRASLEDLGWADWVLSPREV

QVTMCIGACPSQFRAANMHAQIKTSLHRLKPDTVPAPCCVPASYNPMVLI

QKTDTGVSLQTYDDLLAKDCHCI, which is encoded by the nucleic acid sequence:

(SEQ ID NO: 210)
ggtggcccgtcagtcttcctcttcccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagccccatcga gaaaaccatctccaaagccaaagggcagccccgagaaccacaggtgtaca ccctgcccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtgcgcgcgacg gagaccactgtccgctcgggcccgggcgttgctgccgtctgcacacggtc cgcgcgtcgctggaagacctgggctggccgattgggtgctgtcgccacg ggaggtgcaagtgaccatgtgcatcggcgcgtgcccgagccagttccggg cggcaaacatgcacgcgcagatcaagacgagcctgcaccgcctgaagccc gacacggtgccagcgccctgctgcgtgcccgccagctacaatcccatggt gctcattcaaaagaccgacaccggggtgtcgctccagacctatgatgact tgttagccaaagactgccactgcata.

In an embodiment employing the VH21 signal sequence, in a preferred embodiment, the first polypeptide chain comprises the amino acid sequence (signal sequence single underlined):

(SEQ ID NO: 247)
MEWSWVFLFFLSVTTGVHSGGPSVFLFPPKPKDTLMISRTPEVTCVVVDV

SHEDPEVKFNWYVDGVEVHNAKTKPREEQYNSTYRVVSVLTVLHQDWLNG

KEYKCKVSNKALPAPIEKTISKAKGQPREPQVYTLPPSREEMTKNQVSLT

CLVKGFYPSDIAVEWESNGQPENNYDTTPPVLDSDGSFFLYSDLTVDKSR

WQQGNVFSCSVMHEALHNHYTQKSLSLSPGARDGDHCPLGPGRCCRLHTV

RASLEDLGWADWVLSPREVQVTMCIGACPSQFRAANMHAQIKTSLHRLKP

DTVPAPCCVPASYNPMVLIQKTDTGVSLQTYDDLLAKDCHCI, which is encoded by the nucleic acid sequence (signal sequence underlined):

(SEQ ID NO: 248)
atggaatggagctgggtctttctcttcttcctgtcagtaacgactggtgt ccactccggtggcccgtcagtcttcctcttccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtgcgcgcgacg gagaccactgtccgctcgggcccgggcgttgctgccgtctgcacacggtc cgcgcgtcgctggaagacctgggctgggccgattgggtgctgtcgccacg ggaggtgcaagtgaccatgtgcatcggcgcgtgcccgagccagttccggg cggcaaacatgcacgcgcagatcaagacgagcctgcaccgcctgaagccc gacacggtgccagcgccctgctgcgtgcccgccagctacaatcccatggt gctcattcaaaagaccgacaccggggtgtcgctccagacctatgatgact tgttagccaaagactgccactgcata.

In a preferred embodiment, the second polypeptide chain comprises the amino acid sequence of SEQ ID NO:205, which is encoded by the nucleic acid sequence of SEQ ID NO:209.

In an embodiment employing the VH21 signal sequence, in a preferred embodiment, the second polypeptide chain comprises the amino acid sequence of SEQ ID NO:245, which is encoded by the nucleic acid sequence of SEQ ID NO:246.

As discussed above, a tetramer is provided comprising two polypeptide chains comprising the sequence of SEQ ID NO:211 and two polypeptide chains comprising the sequence of SEQ ID NO:205.

II.H.28    GG-Dh2CpmFc(−)(Y349C)-GDF15(Ndel3):GG-Dh2CpmFc(+)(S354C)

The designation "GG-Dh2CpmFc(−)(Y349C)-GDF15 (Ndel3):GG-Dh2CpmFc(+)(S354C)" in the instant disclosure refers to a heterodimer, which comprises (i) a first polypeptide chain comprising GDF15(Ndel3) polypeptide, the N-terminus of which is linked directly to the C-terminus of a GG-Dh2CpmFc(−)(Y349C) domain, and (ii) a second polypeptide chain comprising a GG-Dh2CpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two GG-Dh2CpmFc(−)(Y349C)-GDF15 (Ndel3):GG-Dh2CpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two GG-Dh2CpmFc(+)(S354C) (one each heterodimer) comprising the sequence:

(SEQ ID NO: 300)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPCRKEMTKNQVSLTCLVKGFYPSDIAVEWESNG

QPENNYKTTPPVLKSDGSFFLYSKLTVDKSRWQQGNVFSCSVMHEALHNH

YTQKSLSLSPG, (b) two GG-Dh2CpmFc(−)(Y349C) chains (one each heterodimer) comprising the sequence:

(SEQ ID NO: 213)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVCTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPG, and (c) two GDF15(Ndel3) polypeptides (one each heterodimer) comprising the sequence of SEQ ID NO:55.

In a preferred embodiment, the first polypeptide chain comprises the amino acid sequence:

(SEQ ID NO: 215)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVCTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPGGDHCPLGPGRCCRLHTVRASLEDLGWADWVLSPREVQVT

MCIGACPSQFRAANMHAQIKTSLHRLKPDTVPAPCCVPASYNPMVLIQKT

DTGVSLQTYDDLLAKDCHCI, which is encoded by the nucleic acid sequence:

(SEQ ID NO: 214)
ggtggcccgtcagtcttcctcttccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtgca ccctgcccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact -continued
ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtggagaccact gtccgctcgggcccgggcgttgctgccgtctgcacacggtccgcgcgtcg ctggaagacctgggctggggccgattgggtgctgtcgccacggaggtgca agtgaccatgtgcatcggcgcgtgcccgagccagttccggcggcaaaca tgcacgcgcagatcaagacgagcctgcaccgcctgaagcccgacacggtg ccagcgccctgctgcgtgcccgccagctacaatcccatggtgctcattca aaagaccgacaccggggtgtcgctccagacctatgatgacttgttagcca aagactgccactgcata.

In an embodiment employing the VH21 signal sequence, in a preferred embodiment, the first polypeptide chain comprises the amino acid sequence (signal sequence single underlined):

(SEQ ID NO: 249)
<u>MEWSWVFLFFLSVTTGVHS</u>GGPSVFLFPPKPKDTLMISRTPEVTCVVVDV

SHEDPEVKFNWYVDGVEVHNAKTKPREEQYNSTYRVVSVLTVLHQDWLNG

KEYKCKVSNKALPAPIEKTISKAKGQPREPQVCTLPPSREEMTKNQVSLT

CLVKGFYPSDIAVEWESNGQPENNYDTTPPVLDSDGSFFLYSDLTVDKSR

WQQGNVFSCSVMHEALHNHYTQKSLSLSPGGDHCPLGPGRCCRLHTVRAS

LEDLGWADWVLSPREVQVTMCIGACPSQFRAANMHAQIKTSLHRLKPDTV

PAPCCVPASYNPMVLIQKTDTGVSLQTYDDLLAKDCHCI, which is encoded by the nucleic acid sequence (signal sequence underlined):

(SEQ ID NO: 250)
<u>atggaatggagctgggtctttctcttcttcctgtcagtaacgactggtgt</u>

<u>ccactcc</u>ggtggcccgtcagtcttcctcttccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatgccggaaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtaaa.

In an embodiment employing the VH21 signal sequence, in a preferred embodiment, the second polypeptide chain comprises the amino acid sequence:

(SEQ ID NO: 212)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVYTLPPCRKEMTKNQVSLTCLVKGFYPSDIAVEWESNG

QPENNYKTTPPVLKSDGSFFLYSKLTVDKSRWQQGNVFSCSVMHEALHNH

YTQKSLSLSPGK, which is encoded by the nucleic acid sequence:

(SEQ ID NO: 216)
ggtggcccgtcagtcttcctcttccccccaaaacccaaggaca ccctcatgatctcccggacccctgaggtcacatgcgtggtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagcccccatcga gaaaaccatctccaaagccaaagggcagccccgagaaccacaggtgtaca ccctgcccccatgccggaaggagatgaccaagaaccaggtcagcctgacc tgcctggtcaaaggcttctatcccagcgacatcgccgtggagtgggagag caatgggcagccggagaacaactacaagaccacgcctcccgtgctgaagt ccgacggctccttcttcctctatagcaagctcaccgtggacaagagcagg tggcagcaggggaacgtcttctcatgctccgtgatgcatgaggctctgca caaccactacacgcagaagagcctctccctgtctccgggtaaa.

In an embodiment employing the VH21 signal sequence, in a preferred embodiment, the second polypeptide chain comprises the amino acid sequence (signal sequence single underlined):

(SEQ ID NO: 251)
<u>MEWSWVFLFFLSVTTGVHS</u>GGPSVFLFPPKPKDTLMISRTPEVTCVVVDV

SHEDPEVKFNWYVDGVEVHNAKTKPREEQYNSTYRVVSVLTVLHQDWLNG

KEYKCKVSNKALPAPIEKTISKAKGQPREPQVYTLPPCRKEMTKNQVSLT

CLVKGFYPSDIAVEWESNGQPENNYKTTPPVLKSDGSFFLYSKLTVDKSR

WQQGNVFSCSVMHEALHNHYTQKSLSLSPGK, which is encoded by the nucleic acid sequence (signal sequence underlined):

(SEQ ID NO: 252)
<u>atggaatggagctgggtctttctcttcttcctgtcagtaacgactggtgt</u>

<u>ccactcc</u>ggtggcccgtcagtcttcctcttccccccaaaacccaaggaca

-continued
```
ccctcatgatctcccggaccctgaggtcacatgcgtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagccccatcga gaaaaccatctccaaagccaaagggcagccccgagaaccacaggtgtaca ccctgccccatgccggaaggagatgaccaagaaccaggtcagcctgacc tgcctggtcaaaggcttctatcccagcgacatcgccgtggagtgggagag caatgggcagccggagaacaactacaagaccacgcctcccgtgctgaagt ccgacggctccttcttcctctatagcaagctcaccgtggacaagagcagg tggcagcaggggaacgtcttctcatgctccgtgatgcatgaggctctgca caaccactacacgcagaagagcctctccctgtctccgggtaaa.
```

As discussed above, a tetramer is provided comprising two polypeptide chains comprising the sequence of SEQ ID NO:215 and two polypeptide chains comprising the sequence of SEQ ID NO:212.

II.H.29 GG-Dh2CpmFc(−)(Y349C)-GDF15(N3D):GG-Dh2CpmFc(+)(S354C)

The designation "GG-Dh2CpmFc(−)(Y349C)-GDF15 (N3D):GG-Dh2CpmFc(+)(S354C)" in the instant disclosure refers to a heterodimer, which comprises (i) a first polypeptide chain comprising a GDF15(N3D) polypeptide, the N-terminus of which is linked directly to the C-terminus of a GG-Dh2CpmFc(−)(Y349C) domain, and (ii) a second polypeptide chain comprising a GG-Dh2CpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two GG-Dh2CpmFc(−)(Y349C)-GDF15 (N3D):GG-Dh2CpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two GG-Dh2CpmFc(+)(S354C) domains (one each heterodimer) comprising the sequence of SEQ ID NO:300;
(b) two GG-Dh2CpmFc(−)(Y349C) domains (one each heterodimer) comprising the sequence of SEQ ID NO:213; and
(c) two GDF15(N3D) polypeptides (one each heterodimer) comprising the sequence of SEQ ID NO:52.

In a preferred embodiment, the first polypeptide chain comprises the amino acid sequence:

(SEQ ID NO: 218)
GGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKT

ISKAKGQPREPQVCTLPPSREEMTKNQVSLTCLVKGFYPSDIAVEWESNG

QPENNYDTTPPVLDSDGSFFLYSDLTVDKSRWQQGNVFSCSVMHEALHNH

YTQKSLSLSPGARDGDHCPLGPGRCCRLHTVRASLEDLGWADWVLSPREV

QVTMCIGACPSQFRAANMHAQIKTSLHRLKPDTVPAPCCVPASYNPMVLI

QKTDTGVSLQTYDDLLAKDCHCI, which is encoded by the nucleic acid sequence:

(SEQ ID NO: 217)
```
ggtggcccgtcagtcttcctcttcccccaaaacccaaggaca ccctcatgatctcccggaccctgaggtcacatgcgtggtggacgtg agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagccccatcga gaaaaccatctccaaagccaaagggcagccccgagaaccacaggtgtgca ccctgccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtgcgcgcgacg gagaccactgtccgctcgggcccgggcgttgctgccgtctgcacacggtc cgcgcgtcgctggaagacctgggctgggccgattgggtgctgtcgccacg ggaggtgcaagtgaccatgtgcatcggcgcgtgcccgagccagttccggg cggcaaacatgcacgcgcagatcaagacgagcctgcaccgcctgaagccc gacacggtgccagcgccctgctgcgtgcccgccagctacaatcccatggt gctcattcaaaagaccgacaccggggtgtcgctccagacctatgatgact tgttagccaaagactgccactgcata.
```

In an embodiment employing the VH21 signal sequence, in a preferred embodiment, the first polypeptide chain comprises the amino acid sequence (signal sequence single underlined):

(SEQ ID NO: 253)
<u>MEWSWVFLFFLSVTTGVHS</u>GGPSVFLFPPKPKDTLMISRTPEVTCVVVDV

SHEDPEVKFNWYVDGVEVHNAKTKPREEQYNSTYRVVSVLTVLHQDWLNG

KEYKCKVSNKALPAPIEKTISKAKGQPREPQVCTLPPSREEMTKNQVSLT

CLVKGFYPSDIAVEWESNGQPENNYDTTPPVLDSDGSFFLYSDLTVDKSR

WQQGNVFSCSVMHEALHNHYTQKSLSLSPGARDGDHCPLGPGRCCRLHTV

RASLEDLGWADWVLSPREVQVTMCIGACPSQFRAANMHAQIKTSLHRLKP

DTVPAPCCVPASYNPMVLIQKTDTGVSLQTYDDLLAKDCHCI, which is encoded by the nucleic acid sequence (signal sequence underlined):

(SEQ ID NO: 254)
<u>atggaatggagctgggtctttctcttcttcctgtcagtaacgactggtgt</u>

<u>ccactccggt</u>ggcccgtcagtcttcctcttcccccaaaacccaaggaca ccctcatgatctcccggaccctgaggtcacatgcgtggtggacgtg

```
agccacgaagaccctgaggtcaagttcaactggtacgtggacggcgtgga ggtgcataatgccaagacaaagccgcgggaggagcagtacaacagcacgt accgtgtggtcagcgtcctcaccgtcctgcaccaggactggctgaatggc aaggagtacaagtgcaaggtctccaacaaagccctcccagccccatcga gaaaaccatctccaaagccaaagggcagccccgagaaccacaggtgtgca ccctgccccatcccgggaggagatgaccaagaaccaggtcagcctgacc tgcctggtcaaaggcttctatcccagcgacatcgccgtggagtgggagag caatgggcagccggagaacaactacgacaccacgcctcccgtgctggact ccgacggctccttcttcctctatagcgacctcaccgtggacaagagcagg tggcagcaggggaacgtcttctcatgctccgtgatgcatgaggctctgca caaccactacacgcagaagagcctctccctgtctccgggtgcgcgcgacg gagaccactgtccgctcgggcccgggcgttgctgccgtctgcacacggtc cgcgcgtcgctggaagacctgggctgggccgattgggtgctgtcgccacg ggaggtgcaagtgaccatgtgcatcggcgcgtgcccgagccagttccggg cggcaaacatgcacgcgcagatcaagacgagcctgcaccgcctgaagccc gacacggtgccagcgcctgctgcgtgcccgccagctacaatcccatggt gctcattcaaaagaccgacaccggggtgtcgctccagacctatgatgact tgttagccaaagactgccactgcata.
```

In a preferred embodiment, the second polypeptide chain comprises the amino acid sequence of SEQ ID NO:212, which is encoded by the nucleic acid sequence of SEQ ID NO:218.

In an embodiment employing the VH21 signal sequence, in a preferred embodiment, the second polypeptide chain comprises the amino acid sequence of SEQ ID NO:251, which is encoded by the nucleic acid sequence of SEQ ID NO:252.

As discussed above, a tetramer is provided comprising two polypeptide chains comprising the sequence of SEQ ID NO:218 and two polypeptide chains comprising the sequence of SEQ ID NO:212.

II.H.30 Dh3CpmFc(−)-GDF15(Ndel3):Dh3CpmFc(+)

The designation "Dh3CpmFc(−)-GDF15(Ndel3):Dh3CpmFc(+)" in the instant disclosure refers to a heterodimer, which comprises (i) a first polypeptide chain comprising a GDF15(Ndel3) polypeptide, the N-terminus of which is linked directly to the C-terminus vof a Dh3CpmFc(−) domain, and (ii) a second polypeptide chain comprising a Dh3CpmFc(+) domain.

In certain embodiments, a tetramer is provided, comprising a dimer of two Dh3CpmFc(−)-GDF15(Ndel3):Dh3CpmFc(+) heterodimers in which the two first polypeptide chains of each heterodimer are linked via an interchain disulfide bond between their respective GDF15 regions.

More particularly, in a specific embodiment, the tetramer comprises:

(a) two Dh3CpmFc(+) domains (one each heterodimer) comprising the sequence:

```
                                          (SEQ ID NO: 301)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSRKEMTKNQVSLTCLVKGFYPSDIAVEWESNGQ

PENNYKTTPPVLKSDGSFFLYSKLTVDKSRWQQGNVFSCSVMHEALHNHY

TQKSLSLSPG,
```

(b) two Dh3CpmFc(−) domains (one each heterodimer) comprising the sequence:

```
                                          (SEQ ID NO: 220)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPG,
``` and (c) two GDF15(Ndel3) polypeptides (one each heterodimer) comprising the sequence of SEQ ID NO:55.

In a preferred embodiment, the first polypeptide chain comprises the amino acid sequence:

```
                                          (SEQ ID NO: 222)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPGGDHCPLGPGRCCRLHTVRASLEDLGWADWVLSPREVQVTM

CIGACPSQFRAANMHAQIKTSLHRLKPDTVPAPCCVPASYNPMVLIQKTD

TGVSLQTYDDLLAKDCHCI,
``` which is encoded by the nucleic acid sequence:

```
                                          (SEQ ID NO: 221)
ggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtacaccctgccccatcccgggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtggag accactgtccgctcgggcccgggcgttgctgccgtctgcacacggtccgc gcgtcgctggaagacctgggctgggccgattgggtgctgtcgccacggga
```

-continued
```
ggtgcaagtgaccatgtgcatcggcgcgtgcccgagccagttccgggcgg caaacatgcacgcgcagatcaagacgagcctgcaccgcctgaagcccgac acggtgccagcgccctgctgcgtgccgccagctacaatcccatggtgct cattcaaaagaccgacaccggggtgtcgctccagacctatgatgacttgt tagccaaagactgccactgcata.
```

In an embodiment employing the VK1 signal sequence, in a preferred embodiment, the first polypeptide chain comprises the amino acid sequence (signal sequence single underlined):

```
                                      (SEQ ID NO: 255)
MDMRVPAQLLGLLLLWLRGARCGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVYTLPPSREEMTKNQVS

LTCLVKGFYPSDIAVEWESNGQPENNYDTTPPVLDSDGSFFLYSDLTVDK

SRWQQGNVFSCSVMHEALHNHYTQKSLSLSPGGDHCPLGPGRCCRLHTVR

ASLEDLGWADWVLSPREVQVTMCIGACPSQFRAANMHAQIKTSLHRLKPD

TVPAPCCVPASYNPMVLIQKTDTGVSLQTYDDLLAKDCHCI,
``` which is encoded by the nucleic acid sequence (signal sequence underlined):

```
                                      (SEQ ID NO: 256)
atggacatgagggtgcccgctcagctcctggggctcctgctgctgtggct gagaggtgcgcgctgtggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtacaccctgcccccatcccgggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtggag accactgtccgctcgggcccgggcgttgctgccgtctgcacacggtccgc gcgtcgctggaagacctgggctgggccgattgggtgctgtcgccacggga ggtgcaagtgaccatgtgcatcggcgcgtgcccgagccagttccgggcgg caaacatgcacgcgcagatcaagacgagcctgcaccgcctgaagcccgac acggtgccagcgccctgctgcgtgccgccagctacaatcccatggtgct cattcaaaagaccgacaccggggtgtcgctccagacctatgatgacttgt tagccaaagactgccactgcata.
```

In a preferred embodiment, the second polypeptide chain comprises the amino acid sequence:

```
                                      (SEQ ID NO: 219)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSRKEMTKNQVSLTCLVKGFYPSDIAVEWESNGQ

PENNYKTTPPVLKSDGSFFLYSKLTVDKSRWQQGNVFSCSVMHEALHNHY

TQKSLSLSPGK,
``` which is encoded by the nucleic acid sequence:

```
                                      (SEQ ID NO: 223)
ggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtacaccctgcccccatcccgggaggagatgaccaagaaccaggtcagc ctgacctgcctggtcaaaggcttctatcccagcgacatcgccgtggagtg ggagagcaatgggcagccggagaacaactacaagaccacgcctcccgtgc tgaagtccgacggctccttcttcctctatagcaagctcaccgtggacaag agcaggtggcagcaggggaacgtcttctcatgctccgtgatgcatgaggc tctgcacaaccactacacgcagaagagcctctccctgtctccgggtaaa.
```

In an embodiment employing the VK1 signal sequence, in a preferred embodiment, the second polypeptide chain comprises the amino acid sequence (signal sequence single underlined):

```
                                      (SEQ ID NO: 257)
MDMRVPAQLLGLLLLWLRGARCGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVYTLPPSRKEMTKNQVS

LTCLVKGFYPSDIAVEWESNGQPENNYKTTPPVLKSDGSFFLYSKLTVDK

SRWQQGNVFSCSVMHEALHNHYTQKSLSLSPGK,
``` which is encoded by the nucleic acid sequence (signal sequence underlined):

```
                                      (SEQ ID NO: 258)
atggacatgagggtgcccgctcagctcctggggctcctgctgctgtggct gagaggtgcgcgctgtggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg
```

```
tgtacaccctgcccccatcccggaaggagatgaccaagaaccaggtcagc ctgacctgcctggtcaaaggcttctatcccagcgacatcgccgtggagtg ggagagcaatgggcagccggagaacaactacaagaccacgcctcccgtgc tgaagtccgacggctccttcttcctctatagcaagctcaccgtggacaag agcaggtggcagcaggggaacgtcttctcatgctccgtgatgcatgaggc tctgcacaaccactacacgcagaagagcctctccctgtctccgggtaaa.
```

As discussed above, a tetramer is provided comprising two polypeptide chains comprising the sequence of SEQ ID NO:222 and two polypeptide chains comprising the sequence of SEQ ID NO:219.

II.H.31 Dh3CpmFc(−)-GDF15(N3D):Dh3CpmFc(+)

The designation "Dh3CpmFc(−)-GDF15(N3D): Dh3CpmFc(+)" in the instant disclosure refers to a heterodimer comprising (i) a first polypeptide chain comprising a GDF15(N3D) polypeptide, the N-terminus of which is linked directly to the C-terminus of a Dh3CpmFc(−) domain, and (ii) a second polypeptide chain comprising a Dh3CpmFc(+) domain.

In certain embodiments, a tetramer is provided, comprising a dimer of two Dh3CpmFc(−)-GDF15(N3D): Dh3CpmFc(+) heterodimers in which the two first polypeptide chains of each heterodimer are linked via an interchain disulfide bond between their respective GDF15 regions.

More particularly, in a specific embodiment, the tetramer comprises:

(a) two Dh3CpmFc(+) domains (one each heterodimer) comprising the sequence of SEQ ID NO:301, (b) two Dh3CpmFc(−) (one each heterodimer) comprising the sequence of SEQ ID NO:220, and (c) two GDF15(N3D) polypeptides (one each heterodimer) comprising the sequence of SEQ ID NO:52.

In a preferred embodiment, the first polypeptide chain comprises the amino acid sequence:

```
                                      (SEQ ID NO: 225)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPGARDGDHCPLGPGRCCRLHTVRASLEDLGWADWVLSPREVQ

VTMCIGACPSQFRAANMHAQIKTSLHRLKPDTVPAPCCVPASYNPMVLIQ

KTDTGVSLQTYDDLLAKDCHCI,
``` which is encoded by the nucleic acid sequence:

```
                                      (SEQ ID NO: 224)
atggacatgagggtgcccgctcagctcctggggctcctgctgctgtggct gagaggtgcgcgctgtggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagcccctcccagcccc
```

```
catcgagaaaaccatctccaaagccaaagggcagccccgagaaccacagg tgtacaccctgcccccatcccggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtgcgc gcgacggagaccactgtccgctcgggcccgggcgttgctgccgtctgcac acggtccgcgcgtcgctggaagacctgggctgggccgattgggtgctgtc gccacgggaggtgcaagtgaccatgtgcatcggcgcgtgcccgagccagt tccgggcggcaaacatgcacgcgcagatcaagacgagcctgcaccgcctg aagcccgacacggtgccagcgccctgctgcgtgcccgccagctacaatcc catggtgctcattcaaaagaccgacaccggggtgtcgctccagacctatg atgacttgttagccaaagactgccactgcata.
```

In an embodiment employing the VK1 signal sequence, in a preferred embodiment, the first polypeptide chain comprises the amino acid sequence (signal sequence single underlined):

```
                                      (SEQ ID NO: 259)
MDMRVPAQLLGLLLLWLRGARCGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVYTLPPSREEMTKNQVS

LTCLVKGFYPSDIAVEWESNGQPENNYDTTPPVLDSDGSFFLYSDLTVDK

SRWQQGNVFSCSVMHEALHNHYTQKSLSLSPGARDGDHCPLGPGRCCRLH

TVRASLEDLGWADWVLSPREVQVTMCIGACPSQFRAANMHAQIKTSLHRL

KPDTVPAPCCVPASYNPMVLIQKTDTGVSLQTYDDLLAKDCHCI,
``` which is encoded by the nucleic acid sequence (signal sequence underlined):

```
                                      (SEQ ID NO: 260)
atggacatgagggtgcccgctcagctcctggggctcctgctgctgtggct gagaggtgcgcgctgtggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagcccctcccagcccc catcgagaaaaccatctccaaagccaaagggcagccccgagaaccacagg tgtacaccctgcccccatcccggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag
```

```
agcaggtggcagcaggggaacgtcttctcatgctccgtgatgcatgaggc tctgcacaaccactacacgcagaagagcctctccctgtctccgggtgcgc gcgacggagaccactgtccgctcgggcccgggcgttgctgccgtctgcac acggtccgcgcgtcgctggaagacctgggctgggccgattgggtgctgtc gccacgggaggtgcaagtgaccatgtgcatcggcgcgtgcccgagccagt tccgggcggcaaacatgcacgcgcagatcaagacgagcctgcaccgcctg aagcccgacacggtgccagcgccctgctgcgtgcccgccagctacaatcc catggtgctcattcaaaagaccgacaccggggtgtcgctccagacctatg atgacttgttagccaaagactgccactgcata.
```

In a preferred embodiment, the second polypeptide chain comprises the amino acid sequence of SEQ ID NO:219, which is encoded by the nucleic acid sequence of SEQ ID NO:223.

In an embodiment employing the VK1 signal sequence, in a preferred embodiment, the second polypeptide chain comprises the amino acid sequence of SEQ ID NO:257, which is encoded by the nucleic acid sequence of SEQ ID NO:258.

As discussed above, a tetramer is provided comprising two polypeptide chains comprising the sequence of SEQ ID NO:225 and two polypeptide chains comprising the sequence of SEQ ID NO:219.

II.H.32 Dh3CpmFc(−)(Y349C)-GDF15(Ndel3):Dh3CpmFc(+)(S354C)

The designation "Dh3CpmFc(−)(Y349C)-GDF15(Ndel3):Dh3CpmFc(+)(S354C)" in the instant disclosure refers to a heterodimer, which comprises (i) a first polypeptide chain comprising a GDF15(Ndel3) polypeptide, the N-terminus of which is linked directly to the C-terminus of a Dh3CpmFc(−)(Y349C) domain, and (ii) a second polypeptide chain comprising a Dh3CpmFc(+)(S345C) domain. The cysteine clamp mutations allow the first and second polypeptide chains to be linked via an interchain disulfide bond between C349 of the first polypeptide and C354 of the second polypeptide.

In certain embodiments, a tetramer is provided, comprising a dimer of two Dh3CpmFc(−)(Y349C)-GDF15(Ndel3):Dh3CpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two Dh3CpmFc(+)(S354C) domains (one each heterodimer) comprising the sequence:

```
                                             (SEQ ID NO: 302)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPCRKEMTKNQVSLTCLVKGFYPSDIAVEWESNGQ

PENNYKTTPPVLKSDGSFFLYSKLTVDKSRWQQGNVFSCSVMHEALHNHY

TQKSLSLSPG,
```

(b) two Dh3CpmFc(−)(Y349C) domains (one each heterodimer) comprising the sequence:

```
                                             (SEQ ID NO: 227)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVCTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPG,
``` and (c) two GDF15(Ndel3) polypeptides (one each heterodimer) comprising the sequence of SEQ ID NO:55.

In a preferred embodiment, the first polypeptide chain comprises the amino acid sequence:

```
                                             (SEQ ID NO: 229)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVCTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPGGDHCPLGPGRCCRLHTVRASLEDLGWADWVLSPREVQVTM

CIGACPSQFRAANMHAQIKTSLHRLKPDTVPAPCCVPASYNPMVLIQKTD

TGVSLQTYDDLLAKDCHCI,
``` which is encoded by the nucleic acid sequence:

```
                                             (SEQ ID NO: 228)
atggacatgagggtgcccgctcagctcctggggctcctgctgctgtggct gagaggtgcgcgctgtggcccgtcagtcttcctcttcccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtgcaccctgccccatcccgggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtggag accactgtccgctcgggcccgggcgttgctgccgtctgcacacggtccgc gcgtcgctggaagacctgggctgggccgattgggtgctgtcgccacggga ggtgcaagtgaccatgtgcatcggcgcgtgcccgagccagttccgggcgg caaacatgcacgcgcagatcaagacgagcctgcaccgcctgaagcccgac acggtgccagcgccctgctgcgtgcccgccagctacaatcccatggtgct cattcaaaagaccgacaccggggtgtcgctccagacctatgatgacttgt tagccaaagactgccactgcata.
```

In an embodiment employing the VK1 signal sequence, in a preferred embodiment, the first polypeptide chain comprises the amino acid sequence (signal sequence single underlined):

(SEQ ID NO: 261)
<u>MDMRVPAQLLGLLLLWLRGAR</u>CGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVCTLPPSREEMTKNQVS

LTCLVKGFYPSDIAVEWESNGQPENNYDTTPPVLDSDGSFFLYSDLTVDK

SRWQQGNVFSCSVMHEALHNHYTQKSLSLSPGGDHCPLGPGRCCRLHTVR

ASLEDLGWADWVLSPREVQVTMCIGACPSQFRAANMHAQIKTSLHRLKPD

TVPAPCCVPASYNPMVLIQKTDTGVSLQTYDDLLAKDCHCI, which is encoded by the nucleic acid sequence (signal sequence underlined):

(SEQ ID NO: 262)
<u>atggacatgagggtgcccgctcagctcctggggctcctgctgctgtggct</u>

<u>gagaggtgcgcgctgt</u>ggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtgcaccctgcccccatgccggaaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtgag accactgtccgctcgggcccgggcgttgctgccgtctgcacacggtccgc gcgtcgctggaagacctgggctgggccgattgggtgctgtcgccacggga ggtgcaagtgaccatgtgcatcggcgcgtgcccgagccagttccgggcgg caaacatgcacgcgcagatcaagacgagcctgcaccgcctgaagccgac acggtgccagcgcctgctgcgtgcccgccagctacaatccatggtgct cattcaaaagaccgacaccggggtgtcgctccagacctatgatgacttgt tagccaaagactgccactgcata.

In a preferred embodiment, the second polypeptide chain comprises the amino acid sequence:

(SEQ ID NO: 226)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVYTLPPCRKEMTKNQVSLTCLVKGFYPSDIAVEWESNGQ

PENNYKTTPPVLKSDGSFFLYSKLTVDKSRWQQGNVFSCSVMHEALHNHY

TQKSLSLSPGK, which is encoded by the nucleic acid sequence:

(SEQ ID NO: 230)
ggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtacaccctgcccccatgccggaaggagatgaccaagaaccaggtcagc ctgacctgcctggtcaaaggcttctatcccagcgacatcgccgtggagtg ggagagcaatgggcagccggagaacaactacaagaccacgcctcccgtgc tgaagtccgacggctccttcttcctctatagcaagctcaccgtggacaag agcaggtggcagcaggggaacgtcttctcatgctccgtgatgcatgaggc tctgcacaaccactacacgcagaagagcctctccctgtctccgggtaaa.

In an embodiment employing the VK1 signal sequence, in a preferred embodiment, the second polypeptide chain comprises the amino acid sequence (signal sequence single underlined):

(SEQ ID NO: 263)
<u>MDMRVPAQLLGLLLLWLRGAR</u>CGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVYTLPPCRKEMTKNQVS

LTCLVKGFYPSDIAVEWESNGQPENNYKTTPPVLKSDGSFFLYSKLTVDK

SRWQQGNVFSCSVMHEALHNHYTQKSLSLSPGK, which is encoded by the nucleic acid sequence (signal sequence underlined):

(SEQ ID NO: 264)
<u>atggacatgagggtgcccgctcagctcctggggctcctgctgctgtggct</u>

<u>gagaggtgcgcgctgt</u>ggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaaccatctccaaagccaaagggcagccccgagaaccacagg tgtacaccctgcccccatgccggaaggagatgaccaagaaccaggtcagc ctgacctgcctggtcaaaggcttctatcccagcgacatcgccgtggagtg ggagagcaatgggcagccggagaacaactacaagaccacgcctcccgtgc tgaagtccgacggctccttcttcctctatagcaagctcaccgtggacaag -continued

```
agcaggtggcagcaggggaacgtcttctcatgctccgtgatgcatgaggc tctgcacaaccactacacgcagaagagcctctccctgtctccgggtaaa.
```

As discussed above, a tetramer is provided comprising two polypeptide chains comprising the sequence of SEQ ID NO:229 and two polypeptide chains comprising the sequence of SEQ ID NO:226.

II.H.33 Dh3CpmFc(−)(Y349C)-GDF15(N3D):Dh3CpmFc(+)(S354C)

The designation "Dh3CpmFc(−)(Y349C)-GDF15(N3D):Dh3CpmFc(+)(S354C)" in the instant disclosure refers to a heterodimer, which comprises (i) a first polypeptide chain comprising a GDF15(N3D) polypeptide, the N-terminus of which is linked directly to the C-terminus of a Dh3CpmFc(−)(Y349C) domain, and (ii) a second polypeptide chain comprising a Dh3CpmFc(+)(S345C) domain. The cysteine clamp mutations allow the first and second polypeptide chains to be linked via an interchain disulfide bond between C349 of the first polypeptide chain and C354 of the second polypeptide chain.

In certain embodiments, a tetramer is provided, comprising a dimer of two Dh3CpmFc(−)(Y349C)-GDF15(N3D):Dh3CpmFc(+)(S354C) heterodimers in which the two first polypeptide chains of each heterodimer are linked via an interchain disulfide bond between their respective GDF15 regions.

More particularly, in a specific embodiment, the tetramer comprises:

(a) two Dh3CpmFc(+)(S354C) domains (one each heterodimer) comprising the sequence of SEQ ID NO:302, (b) two Dh3CpmFc(−)(Y349C) domains (one each heterodimer) comprising the sequence of SEQ ID NO:227, and (c) two GDF15(N3D) polypeptides (one each heterodimer) comprising the sequence of SEQ ID NO:52.

In a preferred embodiment, the first polypeptide chain comprises the amino acid sequence:

```
                                        (SEQ ID NO: 232)
GPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTI

SKAKGQPREPQVCTLPPSREEMTKNQVSLTCLVKGFYPSDIAVEWESNGQ

PENNYDTTPPVLDSDGSFFLYSDLTVDKSRWQQGNVFSCSVMHEALHNHY

TQKSLSLSPGARDGDHCPLGPGRCCRLHTVRASLEDLGWADWVLSPREVQ

VTMCIGACPSQFRAANMHAQIKTSLHRLKPDTVPAPCCVPASYNPMVLIQ

KTDTGVSLQTYDDLLAKDCHCI,
``` which is encoded by the nucleic acid sequence:

```
                                        (SEQ ID NO: 231)
ggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaccatctccaaagccaaagggcagccccgagaaccacagg
```

```
tgtgcaccctgcccccatcccgggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc tctgcacaaccactacacgcagaagagcctctccctgtctccgggtgcgc gcgacggagaccactgtccgctcgggcccgggcgttgctgccgtctgcac acggtccgcgcgtcgctggaagacctgggctgggccgattgggtgctgtc gccacgggaggtgcaagtgaccatgtgcatcggcgcgtgcccgagccagt tccgggcggcaaacatgcacgcgcagatcaagacgagcctgcaccgcctg aagcccgacacggtgccagcgcctgctgcgtgcccgccagctacaatcc catggtgctcattcaaaagaccgacaccggggtgtcgctccagacctatg atgacttgttagccaaagactgccactgcata.
```

In an embodiment employing the VK1 signal sequence, in a preferred embodiment, the first polypeptide chain comprises the amino acid sequence (signal sequence single underlined):

```
                                        (SEQ ID NO: 265)
MDMRVPAQLLGLLLLWLRGARCGPSVFLFPPKPKDTLMISRTPEVTCVVV

DVSHEDPEVKFNWYVDGVEVHNAKTKPREEQYNSTYRVVSVLTVLHQDWL

NGKEYKCKVSNKALPAPIEKTISKAKGQPREPQVCTLPPSREEMTKNQVS

LTCLVKGFYPSDIAVEWESNGQPENNYDTTPPVLDSDGSFFLYSDLTVDK

SRWQQGNVFSCSVMHEALHNHYTQKSLSLSPGARDGDHCPLGPGRCCRLH

TVRASLEDLGWADWVLSPREVQVTMCIGACPSQFRAANMHAQIKTSLHRL

KPDTVPAPCCVPASYNPMVLIQKTDTGVSLQTYDDLLAKDCHCI,
``` which is encoded by the nucleic acid sequence (signal sequence underlined):

```
                                        (SEQ ID NO: 266)
atggacatgagggtgcccgctcagctcctggggctcctgctgctgtggct gagaggtgcgcgctgtggcccgtcagtcttcctcttccccccaaaaccca aggacaccctcatgatctcccggacccctgaggtcacatgcgtggtggtg gacgtgagccacgaagaccctgaggtcaagttcaactggtacgtggacgg cgtggaggtgcataatgccaagacaaagccgcgggaggagcagtacaaca gcacgtaccgtgtggtcagcgtcctcaccgtcctgcaccaggactggctg aatggcaaggagtacaagtgcaaggtctccaacaaagccctcccagcccc catcgagaaaccatctccaaagccaaagggcagccccgagaaccacagg tgtgcaccctgcccccatcccgggaggagatgaccaagaaccaggtcagc ctgacctgcctggtcaaaggcttctatcccagcgacatcgccgtggagtg ggagagcaatgggcagccggagaacaactacgacaccacgcctcccgtgc tggactccgacggctccttcttcctctatagcgacctcaccgtggacaag agcaggtggcagcaggggaacgtcttctcatgctccgtgatgcatgaggc
```

-continued
tctgcacaaccactacacgcagaagagcctctccctgtctccgggtgcgc gcgacggagaccactgtccgctcgggcccgggcgttgctgccgtctgcac acggtccgcgcgtcgctggaagacctgggctgggccgattgggtgctgtc gccacgggaggtgcaagtgaccatgtgcatcggcgcgtcccgagccagt tccgggcggcaaacatgcacgcgcagatcaagacgagcctgcaccgcctg aagcccgacacggtgccagcgccctgctgcgtgcccgccagctacaatcc catggtgctcattcaaaagaccgacaccggggtgtcgctccagacctatg atgacttgttagccaaagactgccactgcata.

In a preferred embodiment, the second polypeptide chain comprises the amino acid sequence of SEQ ID NO:226, which is encoded by the nucleic acid sequence of SEQ ID NO:230.

In an embodiment employing the VK1 signal sequence, in a preferred embodiment, the second polypeptide chain comprises the amino acid sequence of SEQ ID NO:263, which is encoded by the nucleic acid sequence of SEQ ID NO:264.

As discussed above, a tetramer is provided comprising two polypeptide chains comprising the sequence of SEQ ID NO:232 and two polypeptide chains comprising the sequence of SEQ ID NO:226.

II.H.34 DhMonoFc(N297G)-GDF15

The designation "DhMonoFc(N297G)-GDF15" in the instant disclosure refers to a fusion protein comprising a GDF15 polypeptide, the N-terminus of which is linked directly to the C-terminus of a DhMonoFc(N297G) domain by a peptide bond.

In certain embodiments, a homodimer is provided comprising two such fusion proteins linked via interchain disulfide bond between their respective GDF15 polypeptides.

More particularly, in a specific embodiment, the homodimer comprises:

(a) two DhMonoFc(N297G) domains (one each monomer) comprising the sequence:

(SEQ ID NO: 233)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG;

and (b) two GDF15 polypeptides (one each heterodimer) comprising the sequence of SEQ ID NO:12.

In a preferred embodiment, the fusion protein comprises the amino acid sequence:

(SEQ ID NO: 235)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPGARNGDHCPLGPGRCCRLHTVRASLEDLGWADWVL

SPREVQVTMCIGACPSQFRAANMHAQIKTSLHRLKPDTVPAPCCVPASYN

PMVLIQKTDTGVSLQTYDDLLAKDCHCI, which is encoded by the nucleic acid sequence:

(SEQ ID NO: 234)
gcacctgaactcctgggggaccgtcagtcttcctcttccccc caaaacccaaggacaccctcatgatctcccggacccctgaggtcacatgc gtggtggtggacgtgagccacgaagaccctgaggtcaagttcaactggta cgtggacggcgtggaggtgcataatgccaagacaaagccgcgggaggagc agtacggcagcacgtaccgtgtggtcagcgtcctcaccgtcctgcaccag gactggctgaatggcaaggagtacaagtgcaaggtctccaacaaagccct cccagccccatcgagaaaaccatctccaaagccaaagggcagccccgag aaccacaggtgacaccctgcccccatcccgggaggagatgaccaagaac caggtcagcctgacctgcctggtcaaaggcttctatcccagcgacatcgc cgtggagtgggagagcaatgggcagccggagaacaactacgacaccacgc ctcccgtgctggactccgacggctccttcttcctctatagcgacctcacc gtggacaagagcaggtggcagcaggggaacgtcttctcatgctccgtgat gcatgaggctctgcacaaccactacacgcagaagagcctctccctgtctc cgggtgcgcgcaacggagaccactgtccgctcgggcccgggcgttgctgc cgtctgcacacggtccgcgcgtcgctggaagacctgggctgggccgattg ggtgctgtcgccacgggaggtgcaagtgaccatgtgcatcggcgcgtgcc cgagccagttccgggcggcaaacatgcacgcgcagatcaagacgagcctg caccgcctgaagcccgacacggtgccagcgccctgctgcgtgcccgccag ctacaatcccatggtgctcattcaaaagaccgacaccggggtgtcgctcc agacctatgatgacttgttagccaaagactgccactgcata.

As discussed above, in a specific embodiment, a homodimer is provided comprising two monomers having the sequence of SEQ ID NO:235.

II.H.35 DhMonoFc(N297G)-(G$_4$S)$_4$-GDF15

The designation "DhMonoFc(N297G)-(G$_4$S)$_4$-GDF15" in the instant disclosure refers to a fusion protein comprising a GDF15 polypeptide linked to a DhMonoFc(N297G) domain via a linker comprising the sequence of SEQ ID NO:18 that connects the N-terminus of the GDF15 polypeptide to the C-terminus of the DhMonoFc(N297G) domain by a peptide bond.

In certain embodiments, a homodimer is provided comprising two such fusion proteins linked via interchain disulfide bond between their respective GDF15 polypeptides.

More particularly, in a specific embodiment, the homodimer comprises:

(a) two DhMonoFc(N297G) domains (one each monomer) comprising the sequence:

(SEQ ID NO: 236)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVTTLPPSREEMTKNQVSLTCLVKGFYPSDIAVE

-continued

WESNGQPENNYDTTPPVLDSDGSFFLYSDLTVDKSRWQQGNVFSCSVMHE

ALHNHYTQKSLSLSPG;

(b) two GDF15 polypeptides (one each monomer) comprising the sequence of SEQ ID NO:12; and (c) two polypeptide linkers (one each monomer) comprising the sequence of SEQ ID NO:18 each linking the N-terminus of a GDF15 polypeptide to the C-terminus of a DhMonoFc(N297G) domain via peptide bonds.

In a preferred embodiment, the fusion protein comprises the amino acid sequence (linker double underlined):

(SEQ ID NO: 238)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u><u>GGGGSGGGGSGGGGSGGGGS</u></u>ARNGDHCPLGPGRC

CRLHTVRASLEDLGWADWVLSPREVQVTMCIGACPSQFRAANMHAQIKTS

LHRLKPDTVPAPCCVPASYNPMVLIQKTDTGVSLQTYDDLLAKDCHCI, which is encoded by the nucleic acid sequence:

(SEQ ID NO: 237)
gcacctgaactcctgggggaccgtcagtcttcctcttccccc caaaacccaaggacaccctcatgatctcccggacccctgaggtcacatgc gtggtggtggacgtgagccacgaagaccctgaggtcaagttcaactggta cgtggacggcgtggaggtgcataatgccaagacaaagccgcgggaggagc agtacggcagcacgtaccgtgtggtcagcgtcctcaccgtcctgcaccag gactggctgaatggcaaggagtacaagtgcaaggtctccaacaaagccct cccagcccccatcgagaaaaccatctccaaagccaaagggcagccccgag aaccacaggtgaccaccctgcccccatcccgggaggagatgaccaagaac caggtcagcctgacctgcctggtcaaaggcttctatcccagcgacatcgc cgtggagtgggagagcaatgggcagccggagaacaactacgacaccacgc ctcccgtgctggactccgacggctccttcttcctctatagcgacctcacc gtggacaagagcaggtggcagcaggggaacgtcttctcatgctccgtgat gcatgaggctctgcacaaccactacacgcagaagagcctctccctgtctc cgggtggaggtggtggatccggaggcggtggaagcggaggtggtggatct ggaggcggtggaagcgcgcaacggagaccactgtccgctcgggccgg gcgttgctgccgtctgcacacggtccgcgcgtcgctggaagacctgggct gggccgattgggtgctgtcgccacgggaggtgcaagtgaccatgtgcatc ggcgcgtgcccgagccagttccggcggcaaacatgcacgcgcagatcaa gacgagcctgcaccgcctgaagcccgacacggtgccagcgccctgctgcg tgcccgccagctacaatcccatggtgctcattcaaaagaccgacaccggg gtgtcgctccagacctatgatgacttgttagccaaagactgccactgcat a.

As discussed above, in a specific embodiment, a homodimer is provided comprising two monomers having the sequence of SEQ ID NO:238.

II.H.36 DhMonoFc(N297G)-G₄-GDF15

The designation "DhMonoFc(N297G)-G₄-GDF15" in the instant disclosure refers to a fusion protein comprising a GDF15 polypeptide linked to a DhMonoFc(N297G) domain via a linker comprising the sequence of SEQ ID NO:58 that connects the N-terminus of the GDF15 polypeptide to the C-terminus of the DhMonoFc(N297G) domain by a peptide bond.

In certain embodiments, a homodimer is provided comprising two such fusion proteins linked via interchain disulfide bond between their respective GDF15 polypeptides.

More particularly, in a specific embodiment, the homodimer comprises:

(a) two DhMonoFc(N297G) domains (one each monomer) comprising the sequence of SEQ ID NO:236;

(b) two GDF15 polypeptides (one each monomer) comprising the sequence of SEQ ID NO:12; and (c) two polypeptide linkers (one each monomer) comprising the sequence of SEQ ID NO:58 each linking the N-terminus of a GDF15 polypeptide to the C-terminus of a DhMonoFc(N297G) domain by peptide bonds.

In a preferred embodiment, the fusion protein comprises the amino acid sequence (linker double underlined):

(SEQ ID NO: 240)
APELLGGPSVFLFPPKPKDTLMISRTPEVTCVVVDVSHEDPEVKFNWYVD

GVEVHNAKTKPREEQYGSTYRVVSVLTVLHQDWLNGKEYKCKVSNKALPA

PIEKTISKAKGQPREPQVTTLPPSREEMTKNQVSLTCLVKGFYPSDIAVE

WESNGQPENNYDTTPPVLDSDGSFFLYSDLTVDKSRWQQGNVFSCSVMHE

ALHNHYTQKSLSLSPG<u><u>GGGG</u></u>ARNGDHCPLGPGRCCRLHTVRASLEDLGWA

DWVLSPREVQVTMCIGACPSQFRAANMHAQIKTSLHRLKPDTVPAPCCVP

ASYNPMVLIQKTDTGVSLQTYDDLLAKDCHCI, which is encoded by the nucleic acid sequence:

(SEQ ID NO: 239)
gcacctgaactcctgggggaccgtcagtcttcctcttccccc caaaacccaaggacaccctcatgatctcccggacccctgaggtcacatgc gtggtggtggacgtgagccacgaagaccctgaggtcaagttcaactggta cgtggacggcgtggaggtgcataatgccaagacaaagccgcgggaggagc agtacggcagcacgtaccgtgtggtcagcgtcctcaccgtcctgcaccag gactggctgaatggcaaggagtacaagtgcaaggtctccaacaaagccct cccagcccccatcgagaaaaccatctccaaagccaaagggcagccccgag aaccacaggtgaccaccctgcccccatcccgggaggagatgaccaagaac caggtcagcctgacctgcctggtcaaaggcttctatcccagcgacatcgc cgtggagtgggagagcaatgggcagccggagaacaactacgacaccacgc ctcccgtgctggactccgacggctccttcttcctctatagcgacctcacc gtggacaagagcaggtggcagcaggggaacgtcttctcatgctccgtgat gcatgaggctctgcacaaccactacacgcagaagagcctctccctgtctc cgggtggaggtggtggagcgcgcaacggagaccactgtccgctcgggccc -continued
gggcgttgctgccgtctgcacacggtccgcgcgtcgctggaagacctggg ctgggccgattgggtgctgtcgccacgggaggtgcaagtgaccatgtgca tcggcgcgtgcccgagccagttccgggcggcaaacatgcacgcgcagatc aagacgagcctgcaccgcctgaagcccgacacggtgccagcgccctgctg cgtgcccgccagctacaatcccatggtgctcattcaaaagaccgacaccg gggtgtcgctccagacctatgatgacttgttagccaaagactgccactgc ata.

As discussed above, in a specific embodiment, a homodimer is provided comprising two monomers having the sequence of SEQ ID NO:240.

III. GDF15 Polypeptides and Constructs Comprising GDF15, Including Mutant Forms Thereof As disclosed herein, the GDF15 polypeptides (including the full length and mature forms of human GDF15) and the constructs comprising GDF15 described in the instant disclosure can be engineered and/or produced using standard molecular biology methodology to form a mutant form of the GDF15 polypeptides and constructs provided herein. In various examples, a nucleic acid sequence encoding a mutant form of the GDF15 polypeptides and constructs provided herein, which can comprise all or a portion of SEQ ID NOs:4, 8 or 12 can be isolated and/or amplified from genomic DNA, or cDNA using appropriate oligonucleotide primers. Primers can be designed based on the nucleic and amino acid sequences provided herein according to standard (RT)-PCR amplification techniques. The amplified GDF15 mutant polypeptide nucleic acid can then be cloned into a suitable vector and characterized by DNA sequence analysis.

Oligonucleotides for use as probes in isolating or amplifying all or a portion of a mutant form of the GDF15 polypeptides and constructs provided herein can be designed and generated using standard synthetic techniques, e.g., automated DNA synthesis apparatus, or can be isolated from a longer sequence of DNA.

III.A. GDF15 Polypeptide and Polynucleotide Sequences

In vivo, GDF15 is expressed as a contiguous amino acid sequence comprising a signal sequence, a pro domain and an active domain.

The 308 amino acid sequence of full length human GDF15 is:

(SEQ ID NO: 4)
MPGQELRTVNGSQMLLVLLVLSWLPHGGALSLAEASRASFPGPSELHSED

SRFRELRKRYEDLLTRLRANQSWEDSNTDLVPAPAVRILTPEVRLGSGGH

LHLRISRAALPEGLPEASRLHRALFRLSPTASRSWDVTRPLRRQLSLARP

QAPALHLRLSPPPSQSDQLLAESSSARPQLELHLRPQAARGRRRARARNG

DHCPLGPGRCCRLHTVRASLEDLGWADWVLSPREVQVTMCIGACPSQFRA

ANMHAQIKTSLHRLKPDTVPAPCCVPASYNPMVLIQKTDTGVSLQTYDDL

LAKDCHCI and is encoded by the DNA sequence:

(SEQ ID NO: 3)
atgcccgggcaagaactcaggacggtgaatggctctcagatgctcctggt gttgctggtgctctcgtggctgccgcatgggggcgccctgtctctggccg aggcgagccgcgcaagtttcccgggacccctcagagttgcactccgaagac tccagattccgagagttgcggaaacgctacgaggacctgctaaccaggct gcgggccaaccagagctgggaagattcgaacaccgacctcgtcccggccc ctgcagtccggatactcacgccagaagtgcggctgggatccggcggccac ctgcacctgcgtatctctcgggccgcccttcccgaggggctccccgaggc ctcccgccttcaccgggctctgttccggctgtccccgacggcgtcaaggt cgtgggacgtgacacgaccgctgcggcgtcagctcagccttgcaagaccc caggcgcccgcgctgcacctgcgactgtcgccgccgccgtcgcagtcgga ccaactgctggcagaatcttcgtccgcacggccccagctggagttgcact tgcggccgcaagccgccaggggggcgccgcagagcgcgtgcgcgcaacggg gaccactgtccgctcgggcccgggcgttgctgccgtctgcacacggtccg cgcgtcgctggaagacctgggctgggccgattgggtgctgtcgccacggg aggtgcaagtgaccatgtgcatcggcgcgtgcccgagccagttccgggcg gcaaacatgcacgcgcagatcaagacgagcctgcaccgcctgaagcccga cacggtgccagcgccctgctgcgtgcccgccagctacaatcccatggtgc tcattcaaaagaccgacaccggggtgtcgctccagacctatgatgacttg ttagccaaagactgccactgcatatga.

The 303 amino acid sequence of full length murine GDF15 is:

(SEQ ID NO: 6)
MAPPALQAQPPGGSQLRFLLFLLLLLLLLSWPSQGDALAMPEQRPSGPES

QLNADELRGRFQDLLSRLHANQSREDSNSEPSPDPAVRILSPEVRLGSHG

QLLLRVNRASLSQGLPEAYRVHRALLLLTPTARPWDITRPLKRALSLRGP

RAPALRLRLTPPPDLAMLPSGGTQLELRLRVAAGRGRRSAHAHPRDSCPL

GPGRCCHLETVQATLEDLGWSDWVLSPRQLQLSMCVGECPHLYRSANTHA

QIKARLHGLQPDKVPAPCCVPSSYTPVVLMHRTDSGVSLQTYDDLVARGC

HCA and is encoded by the DNA sequence:

(SEQ ID NO: 5)
atggccccgccgcgctccaggcccagcctccaggcggctctcaactgag gttcctgctgttcctgctgctgttgctgctgctgctgtcatggccatcgc aggggacgccctggcaatgcctgaacagcgaccctccggccctgagtcc caactcaacgccgacgagctacggggtcgcttccaggacctgctgagccg gctgcatgccaaccagagccgagaggactcgaactcagaaccaagtcctg acccagctgtccggatactcagtccagaggtgagattggggtcccacggc cagctgctactccgcgtcaacgggcgtcgctgagtcagggtctccccga agcctaccgcgtgcaccgagcgctgctcctgctgacgccgacggcccgcc

```
cctgggacatcactaggccctgaagcgtgcgctcagcctccggggaccc cgtgctcccgcattacgcctgcgcctgacgccgcctccggacctggctat gctgccctctggcggcacgcagctggaactgcgcttacgggtagccgcg gcaggggggcgccgaagcgcgcatgcgcacccaagagactcgtgcccactg ggtccggggcgctgctgtcacttggagactgtgcaggcaactcttgaaga cttgggctggagcgactgggtgctgtccccgcgccagctgcagctgagca tgtgcgtgggcgagtgtccccacctgtatcgctccgcgaacacgcatgcg cagatcaaagcacgcctgcatggcctgcagcctgacaaggtgcctgcccc gtgctgtgtcccctccagctacaccccggtggttcttatgcacaggacag acagtggtgtgtcactgcagacttatgatgacctggtggcccggggctgc cactgcgcttga.
```

The amino acid sequence of human GDF15 following cleavage of the 29 residue signal sequence is:

```
                                         (SEQ ID NO: 8)
LSLAEASRASFPGPSELHSEDSRFRELRKRYEDLLTRLRANQSWEDSNTD

LVPAPAVRILTPEVRLGSGGHLHLRISRAALPEGLPEASRLHRALFRLSP

TASRSWDVTRPLRRQLSLARPQAPALHLRLSPPPSQSDQLLAESSSARPQ

LELHLRPQAARGRRRARARNGDHCPLGPGRCCRLHTVRASLEDLGWADWV

LSPREVQVTMCIGACPSQFRAANMHAQIKTSLHRLKPDTVPAPCCVPASY

NPMVLIQKTDTGVSLQTYDDLLAKDCHCI
``` and is encoded by the DNA sequence:

```
                                         (SEQ ID NO: 7)
ctgtctctggccgaggcgagccgcgcaagtttcccgggaccctcagagtt gcactccgaagactccagattccgagagttgcggaaacgctacgaggacc tgctaaccaggctgcgggccaaccagagctgggaagattcgaacaccgac ctcgtcccgccctgcagtccggatactcagccagaagtgcggctggg atccggcggccacctgcacctgcgtatctctcgggccgcccttcccgagg ggctccccgaggcctcccgccttcaccgggctctgttccggctgtccccg acggcgtcaaggtcgtgggacgtgacacgaccgctgcggcgtcagctcag ccttgcaagacccccaggcgcccgcgctgcacctgcgactgtcgccgccgc cgtcgcagtcggaccaactgctggcagaatcttcgtccgcacggcccag ctggagttgcacttgcggccgcaagccgccagggggcgccgcagagcgcg tgcgcgcaacggggaccactgtccgctcgggcccgggcgttgctgccgtc tgcacacggtccgcgcgtcgctggaagacctgggctgggccgattgggtg ctgtcgccacggaggtgcaagtgaccatgtgcatcggcgcgtgcccgag ccagttccgggcggcaaacatgcacgcgcagatcaagacgagcctgcacc gcctgaagcccgacacggtgccagcgcctgctgcgtgccgccagctac aatcccatggtgctcattcaaaagaccgacaccggggtgtcgctccagac ctatgatgacttgttagccaaagactgccactgcatatga
```

The amino acid sequence of murine GDF15 following cleavage of the 32 residue signal sequence is:

```
                                        (SEQ ID NO: 10)
SQGDALAMPEQRPSGPESQLNADELRGRFQDLLSRLHANQSREDSNSEPS

PDPAVRILSPEVRLGSHGQLLLRVNRASLSQGLPEAYRVHRALLLLTPTA

RPWDITRPLKRALSLRGPRAPALRLRLTPPPDLAMLPSGGTQLELRLRVA

AGRGRRSAHAHPRDSCPLGPGRCCHLETVQATLEDLGWSDWVLSPRQLQL

SMCVGECPHLYRSANTHAQIKARLHGLQPDKVPAPCCVPSSYTPVVLMHR

TDSGVSLQTYDDLVARGCHCA
``` and is encoded by the DNA sequence:

```
                                        (SEQ ID NO: 9)
tcgcaggggggacgccctggcaatgcctgaacagcgacccctccggccctga gtcccaactcaacgccgacgagctacggggtcgcttccaggacctgctga gccggctgcatgccaaccagagccgagaggactcgaactcagaaccaagt cctgacccagctgtccggatactcagtccagaggtgagattggggtccca cggccagctgctactccgcgtcaaccgggcgtcgctgagtcagggtctcc ccgaagcctaccgcgtgcaccgagcgctgctcctgctgacgccgacggcc cgcccctgggacatcactaggccctgaagcgtgcgctcagcctccggggg accccgtgctcccgcattacgcctgcgcctgacgccgcctccggacctgg ctatgctgccctctggcggcacgcagctggaactgcgcttacgggtagcc gccggcaggggggcgccgaagcgcgcatgcgcacccaagagactcgtgccc actgggtccggggcgctgctgtcacttggagactgtgcaggcaactcttg aagacttgggctggagcgactgggtgctgtccccgcgccagctgcagctg agcatgtgcgtgggcgagtgtccccacctgtatcgctccgcgaacacgca tgcgcagatcaaagcacgcctgcatggcctgcagcctgacaaggtgcctg ccccgtgctgtgtcccctccagctacaccccggtggttcttatgcacagg acagacagtggtgtgtcactgcagacttatgatgacctggtggcccgggg ctgccactgcgcttga
```

The biologically active form of GDF15 comprises a homodimer comprising two mature GDF15 monomers, each of which comprises SEQ ID NO:12. The monomer that homodimerizes to form the native mature human GDF15 dimer is encoded by the nucleic acid sequence:

```
                                        (SEQ ID NO: 11)
gcgcgcaacggggaccactgtccgctcgggcccgggcgttgctgccgtct gcacacggtccgcgcgtcgctggaagacctgggctgggccgattgggtgc tgtcgccacggaggtgcaagtgaccatgtgcatcggcgcgtgcccgagc cagttccgggcggcaaacatgcacgcgcagatcaagacgagcctgcaccg cctgaagcccgacacggtgccagcgcctgctgcgtgccgccagctaca atcccatggtgctcattcaaaagaccgacaccggggtgtcgctccagacc tatgatgacttgttagccaaagactgccactgcatatga
``` and comprises the amino acid sequence:

```
                                        (SEQ ID NO: 12)
ARNGDHCPLGPGRCCRLHTVRASLEDLGWADWVLSPREVQVTMCIGACPS

QFRAANMHAQIKTSLHRLKPDTVPAPCCVPASYNPMVLIQKTDTGVSLQT

YDDLLAKDCHCI.
```

Thus, the "native mature human GDF15 dimer" comprises two covalently associated monomers comprising SEQ ID NO:12.

The amino acid sequence of the recombinant active form of the human GDF15, which comprises a homodimer comprising nine cysteines in each monomer to form one interchain disulfide bond and four intrachain disulfide bonds (shown with an optional N-terminal methionine residue in parentheses), is:

(SEQ ID NO: 189)
(M)ARNGDHCPLGPGRCCRLHTVRASLEDLGWADWVLSPREVQVTMCIGA

CPSQFRAANMHAQIKTSLHRLKPDTVPAPCCVPASYNPMVLIQKTDTGVS

LQTYDDLLAKDCHCI and is encoded by the DNA sequence (shown with an optional N-terminal methionine codon in parentheses):

(SEQ ID NO: 190)
(atg)gcgcgcaacggggaccactgtccgctcgggcccgggcgttgctgc cgtctgcacacggtccgcgcgtcgctggaagacctgggctgggccgattg ggtgctgtcgccacgggaggtgcaagtgaccatgtgcatcggcgcgtgcc cgagccagttccgggcggcaaacatgcacgcgcagatcaagacgagcctg caccgcctgaagcccgacacggtgccagcgccctgctgcgtgcccgccag ctacaatcccatggtgctcattcaaaagaccgacaccggggtgtcgctcc agacctatgatgacttgttagccaaagactgccactgcatataa.

The amino acid sequence of the recombinant active form of the murine GDF15, which comprises a homodimer comprising nine cysteines in each monomer to form one interchain disulfide bond and four intrachain disulfide bonds, is:

(SEQ ID NO: 14)
(M)SAHAHPRDSCPLGPGRCCHLETVQATLEDLGWSDWVLSPRQLQLSMC

VGECPHLYRSANTHAQIKARLHGLQPDKVPAPCCVPSSYTPVVLMHRTDS

GVSLQTYDDLVARGCHCA and is encoded by the DNA sequence:

(SEQ ID NO: 13)
(atg)agcgcgcatgcgcacccaagagactcgtgcccactgggtccgggg cgctgctgtcacctggagactgtgcaggcaactcttgaagacttgggctg gagcgactgggtgttgtccccgcgccagctgcagctgagcatgtgcgtgg gcgagtgtccccacctgtatcgctccgcgaacacgcatgcgcagatcaaa gcacgcctgcatggcctgcagcctgacaaggtgcctgccccgtgctgtgt ccctccagctacacccggtggttcttatgcacaggacagacagtggtg tgtcactgcagacttatgatgacctggtggcccggggctgccactgcgct tga.

As stated herein, the term "GDF15 polypeptide" refers to a GDF polypeptide comprising the human amino acid sequences SEQ ID NOs:4, 8 and 12. The term "GDF15 mutant polypeptide," however, encompasses polypeptides comprising an amino acid sequence that differs from the amino acid sequence of a naturally-occurring GDF polypeptide sequence, e.g., SEQ ID NOs: 4, 8 and 12, by one or more amino acids, such that the sequence is at least 85% identical to SEQ ID NOs: 4, 8 and 12. GDF15 polypeptides can be generated by introducing one or more amino acid substitutions, either conservative or non-conservative or using naturally or non-naturally-occurring amino acids, at particular positions of the GDF15 polypeptide, or by deleting particular residues or stretches of residues.

A "conservative amino acid substitution" can involve a substitution of a native amino acid residue (i.e., a residue found in a given position of the wild-type GDF15 polypeptide sequence) with a non-native residue (i.e., a residue that is not found in a given position of the wild-type GDF15 polypeptide sequence) such that there is little or no effect on the polarity or charge of the amino acid residue at that position. Conservative amino acid substitutions also encompass non-naturally-occurring amino acid residues (as defined herein) that are typically incorporated by chemical peptide synthesis rather than by synthesis in biological systems. These include peptidomimetics, and other reversed or inverted forms of amino acid moieties.

Naturally-occurring residues can be divided into classes based on common side chain properties:
  (1) hydrophobic: norleucine, Met, Ala, Val, Leu, Ile;
  (2) neutral hydrophilic: Cys, Ser, Thr;
  (3) acidic: Asp, Glu;
  (4) basic: Asn, Gln, His, Lys, Arg;
  (5) residues that influence chain orientation: Gly, Pro; and
  (6) aromatic: Trp, Tyr, Phe.

Additional groups of amino acids can also be formulated using the principles described in, e.g., Creighton (1984) PROTEINS: STRUCTURE AND MOLECULAR PROPERTIES (2d Ed. 1993), W. H. Freeman and Company. In some instances it can be useful to further characterize substitutions based on two or more of such features (e.g., substitution with a "small polar" residue, such as a Thr residue, can represent a highly conservative substitution in an appropriate context).

Conservative substitutions can involve the exchange of a member of one of these classes for another member of the same class. Non-conservative substitutions can involve the exchange of a member of one of these classes for a member from another class.

Synthetic, rare, or modified amino acid residues having known similar physiochemical properties to those of an above-described grouping can be used as a "conservative" substitute for a particular amino acid residue in a sequence. For example, a D-Arg residue may serve as a substitute for a typical L-Arg residue. It also can be the case that a particular substitution can be described in terms of two or more of the above described classes (e.g., a substitution with a small and hydrophobic residue means substituting one amino acid with a residue(s) that is found in both of the above-described classes or other synthetic, rare, or modified residues that are known in the art to have similar physiochemical properties to such residues meeting both definitions).

Nucleic acid sequences encoding a GDF15 mutant polypeptide provided herein, including those degenerate to SEQ ID NOs: 3, 7, 11 and 15, and those encoding polypeptide variants of SEQ ID NOs:4, 8 and 12, form other aspects of the instant disclosure.

III.B. Vectors Useful for Expressing GDF15 Polypeptides and Constructs Comprising GDF15, Including Mutant Forms Thereof In order to express the nucleic acid sequences encoding a polypeptide comprising a GDF15 region, the appropriate coding sequences, e.g., SEQ ID NOs:3, 7 and 11, can be cloned into a suitable vector and after introduction in a suitable host, the sequence can be expressed to produce the encoded polypeptide according to standard cloning and expression techniques, which are known in the art (e.g., as described in Sambrook, J., Fritsh, E. F., and Maniatis, T. Molecular Cloning: A Laboratory Manual 2nd, ed., Cold Spring Harbor Laboratory, Cold Spring Harbor Laboratory Press, Cold Spring Harbor, N.Y., 1989). The invention also relates to such vectors comprising a nucleic acid sequence according to the invention.

A "vector" refers to a delivery vehicle that (a) promotes the expression of a polypeptide-encoding nucleic acid sequence; (b) promotes the production of the polypeptide therefrom; (c) promotes the transfection/transformation of target cells therewith; (d) promotes the replication of the nucleic acid sequence; (e) promotes stability of the nucleic acid; (f) promotes detection of the nucleic acid and/or transformed/transfected cells; and/or (g) otherwise imparts advantageous biological and/or physiochemical function to the polypeptide-encoding nucleic acid. A vector can be any suitable vector, including chromosomal, non-chromosomal, and synthetic nucleic acid vectors (a nucleic acid sequence comprising a suitable set of expression control elements). Examples of such vectors include derivatives of SV40, bacterial plasmids, phage DNA, baculovirus, yeast plasmids, vectors derived from combinations of plasmids and phage DNA, and viral nucleic acid (RNA or DNA) vectors.

A recombinant expression vector can be designed for expression of a polypeptide comprising a GDF15 region in prokaryotic (e.g., *E. coli*) or eukaryotic cells (e.g., insect cells, using baculovirus expression vectors, yeast cells, or mammalian cells). Representative host cells include those hosts typically used for cloning and expression, including *Escherichia coli* strains TOP10F', TOP10, DH10B, DH5a, HB101, W3110, BL21(DE3) and BL21 (DE3)pLysS, BLUESCRIPT (Stratagene), mammalian cell lines CHO, CHO-K1, HEK293, 293-EBNA pIN vectors (Van Heeke & Schuster, *J. Biol. Chem.* 264: 5503-5509 (1989); pET vectors (Novagen, Madison Wis.). Alternatively, the recombinant expression vector can be transcribed and translated in vitro, for example using T7 promoter regulatory sequences and T7 polymerase and an in vitro translation system. Preferably, the vector contains a promoter upstream of the cloning site containing the nucleic acid sequence encoding the polypeptide. Examples of promoters, which can be switched on and off, include the lac promoter, the T7 promoter, the trc promoter, the tac promoter and the trp promoter.

Thus, provided herein are vectors comprising a nucleic acid sequence encoding a polypeptide comprising a GDF15 region that facilitate the expression of the polypeptide or construct of interest. In various embodiments, the vectors comprise an operably linked nucleotide sequence which regulates the expression of a polypeptide comprising a GDF15 region. A vector can comprise or be associated with any suitable promoter, enhancer, and other expression-facilitating elements. Examples of such elements include strong expression promoters (e.g., a human CMV IE promoter/enhancer, an RSV promoter, SV40 promoter, SL3-3 promoter, MMTV promoter, or HIV LTR promoter, EF1alpha promoter, CAG promoter), effective poly (A) termination sequences, an origin of replication for plasmid product in *E. coli*, an antibiotic resistance gene as a selectable marker, and/or a convenient cloning site (e.g., a polylinker). Vectors also can comprise an inducible promoter as opposed to a constitutive promoter such as CMV IE. In one aspect, a nucleic acid comprising a sequence encoding a polypeptide comprising a GDF15 region which is operatively linked to a tissue specific promoter which promotes expression of the sequence in a metabolically-relevant tissue, such as liver or pancreatic tissue is provided.

III.C. Host Cells

In another aspect of the instant disclosure, host cells comprising the nucleic acids and vectors disclosed herein are provided. In various embodiments, the vector or nucleic acid is integrated into the host cell genome, which in other embodiments the vector or nucleic acid is extra-chromosomal.

Recombinant cells, such as yeast, bacterial (e.g., *E. coli*), and mammalian cells (e.g., immortalized mammalian cells) comprising such a nucleic acid, vector, or combinations of either or both thereof are provided. In various embodiments, cells comprising a non-integrated nucleic acid, such as a plasmid, cosmid, phagemid, or linear expression element, which comprises a sequence coding for expression of a polypeptide comprising a GDF15 region.

A vector comprising a nucleic acid sequence encoding a polypeptide comprising a GDF15 region can be introduced into a host cell by transformation or by transfection. Methods of transforming a cell with an expression vector are well known.

A nucleic acid encoding a polypeptide comprising a GDF15 region can be positioned in and/or delivered to a host cell or host animal via a viral vector. Any suitable viral vector can be used in this capacity. A viral vector can comprise any number of viral polynucleotides, alone or in combination with one or more viral proteins, which facilitate delivery, replication, and/or expression of the nucleic acid of the invention in a desired host cell. The viral vector can be a polynucleotide comprising all or part of a viral genome, a viral protein/nucleic acid conjugate, a virus-like particle (VLP), or an intact virus particle comprising viral nucleic acids and a nucleic acid encoding a polypeptide comprising a GDF15 region. A viral particle viral vector can comprise a wild-type viral particle or a modified viral particle. The viral vector can be a vector which requires the presence of another vector or wild-type virus for replication and/or expression (e.g., a viral vector can be a helper-dependent virus), such as an adenoviral vector amplicon. Typically, such viral vectors consist of a wild-type viral particle, or a viral particle modified in its protein and/or nucleic acid content to increase transgene capacity or aid in transfection and/or expression of the nucleic acid (examples of such vectors include the herpes virus/AAV amplicons). Typically, a viral vector is similar to and/or derived from a virus that normally infects humans. Suitable viral vector particles in this respect, include, for example, adenoviral vector particles (including any virus of or derived from a virus of the adenoviridae), adeno-associated viral vector particles (AAV vector particles) or other parvoviruses and parvoviral vector particles, papillomaviral vector particles, flaviviral vectors, alphaviral vectors, herpes viral vectors, pox virus vectors, retroviral vectors, including lentiviral vectors.

III.D. Isolation of a GDF15 Polypeptide, Construct Comprising a GDF15 Polypeptide or a Mutant Form Thereof A polypeptide comprising a GDF15 region can be isolated using standard protein purification methods. A polypeptide comprising a GDF15 region can be isolated from a cell that has been engineered to express a polypeptide comprising a GDF15 region, for example a cell that does not naturally express native GDF15.

Protein purification methods that can be employed to isolate polypeptide comprising a GDF15 region, as well as associated materials and reagents, are known in the art.

Exemplary methods of purifying polypeptide comprising a GDF15 region are provided in the Examples herein below. Additional purification methods that may be useful for isolating polypeptide comprising a GDF15 region can be found in references such as Bootcov M R, 1997, *Proc. Natl. Acad. Sci. USA* 94:11514-9, Fairlie W D, 2000, *Gene* 254: 67-76.

IV. Pharmaceutical Compositions Comprising a GDF15 Polypeptide, Construct Comprising a GDF15 Polypeptide or a Mutant Form Thereof Pharmaceutical compositions comprising a monomer or multimer comprising a polypeptide comprising a GDF15 region are provided. Such polypeptide pharmaceutical compositions can comprise a therapeutically effective amount of a polypeptide comprising a monomer or multimer comprising a polypeptide comprising a GDF15 region in admixture with a pharmaceutically or physiologically acceptable formulation agent selected for suitability with the mode of administration. The term "pharmaceutically acceptable carrier" or "physiologically acceptable carrier" as used herein refers to one or more formulation agents suitable for accomplishing or enhancing the delivery of a monomer or multimer comprising a polypeptide comprising a GDF15 region into the body of a human or non-human subject. The term includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In some cases it will be preferable to include isotonic agents, for example, sugars, polyalcohols such as mannitol, sorbitol, or sodium chloride in a pharmaceutical composition. Pharmaceutically acceptable substances such as wetting or minor amounts of auxiliary substances such as wetting or emulsifying agents, preservatives or buffers, which enhance the shelf life or effectiveness of the monomer or multimer comprising a polypeptide comprising a GDF15 region can also act as, or form a component of, a carrier. Acceptable pharmaceutically acceptable carriers are preferably nontoxic to recipients at the dosages and concentrations employed.

A pharmaceutical composition can contain formulation agent(s) for modifying, maintaining, or preserving, for example, the pH, osmolarity, viscosity, clarity, color, isotonicity, odor, sterility, stability, rate of dissolution or release, adsorption, or penetration of the composition. Suitable formulation agents include, but are not limited to, amino acids (such as glycine, glutamine, asparagine, arginine, or lysine), antimicrobials, antioxidants (such as ascorbic acid, sodium sulfite, or sodium hydrogen-sulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as free serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as Polysorbate 20 or Polysorbate 80; Triton; tromethamine; lecithin; cholesterol or tyloxapal), stability enhancing agents (such as sucrose or sorbitol), tonicity enhancing agents (such as alkali metal halides—preferably sodium or potassium chloride—or mannitol sorbitol), delivery vehicles, diluents, excipients and/or pharmaceutical adjuvants (see, e.g., REMINGTON: THE SCIENCE AND PRACTICE OF PHARMACY, 19th edition, (1995); Berge et al., J. Pharm. Sci., 6661), 1-19 (1977). Additional relevant principles, methods, and agents are described in, e.g., Lieberman et al., PHARMACEUTICAL DOSAGE FORMS-DISPERSE SYSTEMS (2nd ed., vol. 3, 1998); Ansel et al., PHARMACEUTICAL DOSAGE FORMS & DRUG DELIVERY SYSTEMS (7th ed. 2000); Martindale, THE EXTRA PHARMACOPEIA (31st edition), Remington's PHARMACEUTICAL SCIENCES (16th-20$^{th}$ and subsequent editions); The Pharmacological Basis Of Therapeutics, Goodman and Gilman, Eds. (9th ed.—1996); Wilson and Gisvolds' TEXTBOOK OF ORGANIC MEDICINAL AND PHARMACEUTICAL CHEMISTRY, Delgado and Remers, Eds. (10th ed., 1998). Principles of formulating pharmaceutically acceptable compositions also are described in, e.g., Aulton, PHARMACEUTICS: THE SCIENCE OF DOSAGE FORM DESIGN, Churchill Livingstone (New York) (1988), EXTEMPORANEOUS ORAL LIQUID DOSAGE PREPARATIONS, CSHP (1998)).

The optimal pharmaceutical composition will be determined by a skilled artisan depending upon, for example, the intended route of administration, delivery format, and desired dosage (see, e.g., Remington's PHARMACEUTICAL SCIENCES, supra). Such compositions can influence the physical state, stability, rate of in vivo release, and rate of in vivo clearance of a GDF15 polypeptide, construct comprising a GDF15 polypeptide or a mutant form thereof.

The primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with free serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the present invention, compositions comprising a GDF15 polypeptide, construct comprising a GDF15 polypeptide or a mutant form thereof can be prepared for storage by mixing the selected composition having the desired degree of purity with optional formulation agents (Remington's PHARMACEUTICAL SCIENCES, supra) in the form of a lyophilized cake or an aqueous solution. Furthermore, a product comprising a monomer or multimer comprising a polypeptide comprising a GDF15 region can be formulated as a lyophilizate using appropriate excipients such as sucrose.

The polypeptide pharmaceutical compositions can be selected for parenteral delivery. Alternatively, the compositions can be selected for inhalation or for delivery through the digestive tract, such as orally. The preparation of such pharmaceutically acceptable compositions is within the skill of the art.

The formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use in this invention can be in the form of a pyrogen-free, parenterally acceptable, aqueous solution comprising a desired GDF15 polypeptide, construct comprising a GDF15 polypeptide or a mutant form thereof, in a pharmaceutically acceptable vehicle. A particularly suitable vehicle for parenteral injection is sterile distilled water in which a GDF15 polypeptide, construct comprising a monomer or multimer comprising a polypeptide comprising a GDF15 region is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a monomer or multimer comprising a polypeptide comprising a GDF15 region can be formulated as a dry powder for inhalation. Inhalation solutions comprising a monomer or multimer comprising a polypeptide comprising a GDF15 region can also be formulated with a propellant for aerosol delivery. In yet another embodiment, solutions can be nebulized. Pulmonary administration is further described in International Publication No. WO 94/20069, which describes the pulmonary delivery of chemically modified proteins.

It is also contemplated that certain formulations can be administered orally. In one embodiment of the present invention, a monomer or multimer comprising a polypeptide comprising a GDF15 region that is administered in this fashion can be formulated with or without those carriers customarily used in the compounding of solid dosage forms such as tablets and capsules. For example, a capsule can be designed to release the active portion of the formulation at the point in the gastrointestinal tract when bioavailability is maximized and pre-systemic degradation is minimized Additional agents can be included to facilitate absorption of a monomer or multimer comprising a polypeptide comprising a GDF15 region. Diluents, flavorings, low melting point waxes, vegetable oils, lubricants, suspending agents, tablet disintegrating agents, and binders can also be employed.

Another pharmaceutical composition can involve an effective quantity of a monomer or multimer comprising a polypeptide comprising a GDF15 region in a mixture with nontoxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions comprising a monomer or multimer comprising a polypeptide comprising a GDF15 region will be evident to those skilled in the art, including formulations comprising a monomer or multimer comprising a polypeptide comprising a GDF15 region, in sustained- or controlled-delivery formulations. Techniques for formulating a variety of other sustained- or controlled-delivery means, such as liposome carriers, bio-erodible microparticles or porous beads and depot injections, are also known to those skilled in the art (see, e.g., International Publication No. WO 93/15722, which describes the controlled release of porous polymeric microparticles for the delivery of pharmaceutical compositions, and Wischke & Schwendeman, 2008, Int. J. Pharm. 364: 298-327, and Freiberg & Zhu, 2004, Int. J. Pharm. 282: 1-18, which discuss microsphere/microparticle preparation and use). As described herein, a hydrogel is an example of a sustained- or controlled-delivery formulation.

Additional examples of sustained-release preparations include semipermeable polymer matrices in the form of shaped articles, e.g. films, or microcapsules. Sustained release matrices can include polyesters, hydrogels, polylactides (U.S. Pat. No. 3,773,919 and European Patent No. 0 058 481), copolymers of L-glutamic acid and gamma ethyl-L-glutamate (Sidman et al., 1983, Biopolymers 22: 547-56), poly(2-hydroxyethyl-methacrylate) (Langer et al., 1981, J. Biomed. Mater. Res. 15: 167-277 and Langer, 1982, Chem. Tech. 12: 98-105), ethylene vinyl acetate (Langer et al., supra) or poly-D(−)-3-hydroxybutyric acid (European Patent No. 0 133 988). Sustained-release compositions can also include liposomes, which can be prepared by any of several methods known in the art. See, e.g., Epstein et al., 1985, Proc. Natl. Acad. Sci. U.S.A. 82: 3688-92; and European Patent Nos. 0 036 676, 0 088 046, and 0 143 949.

A pharmaceutical composition comprising a monomer or multimer comprising a polypeptide comprising a GDF15 region which is to be used for in vivo administration typically should be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper pierceable by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

In a specific embodiment, the present invention is directed to kits for producing a single-dose administration unit. The kits can each contain both a first container having a dried protein and a second container having an aqueous formulation. Also included within the scope of this invention are kits containing single and multi-chambered pre-filled syringes (e.g., liquid syringes and lyosyringes).

The effective amount of pharmaceutical composition comprising a monomer or multimer comprising a polypeptide comprising a GDF15 region which is to be employed therapeutically will depend, for example, upon the therapeutic context and objectives. One skilled in the art will appreciate that the appropriate dosage levels for treatment will thus vary depending, in part, upon the molecule delivered, the indication for which a monomer or multimer comprising a polypeptide comprising a GDF15 region is being used, the route of administration, and the size (body weight, body surface, or organ size) and condition (the age and general health) of the patient. Accordingly, the clinician can titer the dosage and modify the route of administration to obtain the optimal therapeutic effect. A typical dosage can range from about 0.1 µg/kg to up to about 100 mg/kg or more, depending on the factors mentioned above. In other embodiments, the dosage can range from 0.1 µg/kg up to about 100 mg/kg; or 1 µg/kg up to about 100 mg/kg; or 5 µg/kg, 10 µg/kg, 15 µg/kg, 20 µg/kg, 25 µg/kg, 30 µg/kg, 35 µg/kg, 40 µg/kg, 45 µg/kg, 50 µg/kg, 55 µg/kg, 60 µg/kg, 65 µg/kg, 70 µg/kg, 75 µg/kg, 100 µg/kg, 200 µg/kg or up to about 10 mg/kg.

The frequency of dosing will depend upon the pharmacokinetic parameters of the a monomer or multimer comprising a polypeptide comprising a GDF15 region in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems (which may also be injected); or by implantation devices. Where desired, the compositions can be administered by bolus injection or continuously by infusion, or by implantation device.

Alternatively or additionally, the composition can be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

In order to deliver drug, e.g., a monomer or multimer comprising a polypeptide comprising a GDF15 region, at a predetermined rate such that the drug concentration can be maintained at a desired therapeutically effective level over an extended period, a variety of different approaches can be employed. In one example, a hydrogel comprising a polymer such as a gelatin (e.g., bovine gelatin, human gelatin, or gelatin from another source) or a naturally-occurring or a synthetically generated polymer can be employed. Any percentage of polymer (e.g., gelatin) can be employed in a hydrogel, such as 5, 10, 15 or 20%. The selection of an appropriate concentration can depend on a variety of factors, such as the therapeutic profile desired and the pharmacokinetic profile of the therapeutic molecule.

Examples of polymers that can be incorporated into a hydrogel include polyethylene glycol ("PEG"), polyethylene oxide, polyethylene oxide-co-polypropylene oxide, co-polyethylene oxide block or random copolymers, polyvinyl alcohol, poly(vinyl pyrrolidinone), poly(amino acids), dextran, heparin, polysaccharides, polyethers and the like.

Another factor that can be considered when generating a hydrogel formulation is the degree of crosslinking in the hydrogel and the crosslinking agent. In one embodiment, cross-linking can be achieved via a methacrylation reaction involving methacrylic anhydride. In some situations, a high degree of cross-linking may be desirable while in other situations a lower degree of crosslinking is preferred. In some cases a higher degree of crosslinking provides a longer sustained release. A higher degree of crosslinking may provide a firmer hydrogel and a longer period over which drug is delivered.

Any ratio of polymer to crosslinking agent (e.g., methacrylic anhydride) can be employed to generate a hydrogel with desired properties. For example, the ratio of polymer to crosslinker can be, e.g., 8:1, 16:1, 24:1, or 32:1. For example, when the hydrogel polymer is gelatin and the crosslinker is methacrylate, ratios of 8:1, 16:1, 24:1, or 32:1 methacrylic anhydride:gelatin can be employed.

V. Therapeutic Uses of a GDF15 Polypeptide, Construct Comprising a GDF15 Polypeptide or a Mutant Form Thereof A monomer or multimer comprising a polypeptide comprising a GDF15 region can be used to treat, diagnose or ameliorate, a metabolic condition or disorder. In one embodiment, the metabolic disorder to be treated is diabetes, e.g., type 2 diabetes. In another embodiment, the metabolic condition or disorder is obesity. In other embodiments the metabolic condition or disorder is dyslipidemia, elevated glucose levels, elevated insulin levels or diabetic nephropathy. For example, a metabolic condition or disorder that can be treated or ameliorated using a monomer or multimer comprising a polypeptide comprising a GDF15 region includes a state in which a human subject has a fasting blood glucose level of 125 mg/dL or greater, for example 130, 135, 140, 145, 150, 155, 160, 165, 170, 175, 180, 185, 190, 195, 200 or greater than 200 mg/dL. Blood glucose levels can be determined in the fed or fasted state, or at random. The metabolic condition or disorder can also comprise a condition in which a subject is at increased risk of developing a metabolic condition. For a human subject, such conditions include a fasting blood glucose level of 100 mg/dL. Conditions that can be treated using a pharmaceutical composition comprising a GDF15 mutant polypeptide can also be found in the American Diabetes Association Standards of Medical Care in Diabetes Care-2011, American Diabetes Association, Diabetes Care Vol. 34, No. Supplement 1, S11-S61, 2010.

In application, a metabolic disorder or condition, such as Type 2 diabetes, elevated glucose levels, elevated insulin levels, dyslipidemia, obesity or diabetic nephropathy, can be treated by administering a therapeutically effective dose of a GDF15 polypeptide, construct comprising a monomer or multimer comprising a polypeptide comprising a GDF15 region to a patient in need thereof. The administration can be performed as described herein, such as by IV injection, intraperitoneal (IP) injection, subcutaneous injection, intramuscular injection, or orally in the form of a tablet or liquid formation. In some situations, a therapeutically effective or preferred dose of a monomer or multimer comprising a polypeptide comprising a GDF15 region can be determined by a clinician. A therapeutically effective dose of a monomer or multimer comprising a polypeptide comprising a GDF15 region will depend, inter alia, upon the administration schedule, the unit dose of agent administered, whether the a monomer or multimer comprising a polypeptide comprising a GDF15 region is administered in combination with other therapeutic agents, the immune status and the health of the recipient. The term "therapeutically effective dose," as used herein, means an amount of a monomer or multimer comprising a polypeptide comprising a GDF15 region that elicits a biological or medicinal response in a tissue system, animal, or human being sought by a researcher, medical doctor, or other clinician, which includes alleviation or amelioration of the symptoms of the disease or disorder being treated, i.e., an amount of a monomer or multimer comprising a polypeptide comprising a GDF15 region that supports an observable level of one or more desired biological or medicinal response, for example, lowering blood glucose, insulin, triglyceride, or cholesterol levels; reducing body weight; or improving glucose tolerance, energy expenditure, or insulin sensitivity.

It is noted that a therapeutically effective dose of a monomer or multimer comprising a polypeptide comprising a GDF15 region can also vary with the desired result. Thus, for example, in situations in which a lower level of blood glucose is indicated a dose of a monomer or multimer comprising a polypeptide comprising a GDF15 region will be correspondingly higher than a dose in which a comparatively lower level of blood glucose is desired. Conversely, in situations in which a higher level of blood glucose is indicated at a dose of a monomer or multimer comprising a polypeptide comprising a GDF15 region will be correspondingly lower than a dose in which a comparatively higher level of blood glucose is desired.

In various embodiments, a subject is a human having a blood glucose level of 100 mg/dL or greater can be treated with a monomer or multimer comprising a polypeptide comprising a GDF15 region.

In one embodiment, a method of the instant disclosure comprises first measuring a baseline level of one or more metabolically-relevant compounds such as glucose, insulin, cholesterol, lipid in a subject. A pharmaceutical composition comprising a monomer or multimer comprising a polypeptide comprising a GDF15 region is then administered to the subject. After a desired period of time, the level of the one or more metabolically-relevant compounds (e.g., blood glucose, insulin, cholesterol, lipid) in the subject is again measured. The two levels can then be compared in order to determine the relative change in the metabolically-relevant compound in the subject. Depending on the outcome of that comparison another dose of the pharmaceutical composition comprising a monomer or multimer comprising a polypeptide comprising a GDF15 region can be administered to achieve a desired level of one or more metabolically-relevant compound.

It is noted that a pharmaceutical composition comprising a monomer or multimer comprising a polypeptide comprising a GDF15 region can be co-administered with another compound. The identity and properties of compound co-administered with the a monomer or multimer comprising a polypeptide comprising a GDF15 region will depend on the nature of the condition to be treated or ameliorated. A non-limiting list of examples of compounds that can be administered in combination with a pharmaceutical composition comprising a monomer or multimer comprising a polypeptide comprising a GDF15 region include rosiglitizone, pioglitizone, repaglinide, nateglitinide, metformin, exenatide, stiagliptin, pramlintide, glipizide, glimeprirideacarbose, and miglitol.

VI. Kits

Also provided are kits for practicing the disclosed methods. Such kits can comprise a pharmaceutical composition such as those described herein, including nucleic acids encoding the peptides or proteins provided herein, vectors and cells comprising such nucleic acids, and pharmaceutical compositions comprising such nucleic acid-containing compounds, which can be provided in a sterile container. Optionally, instructions on how to employ the provided pharmaceutical composition in the treatment of a metabolic disorder can also be included or be made available to a patient or a medical service provider.

In one aspect, a kit comprises (a) a pharmaceutical composition comprising a therapeutically effective amount of a monomer or multimer comprising a polypeptide comprising a GDF15 region; and (b) one or more containers for the pharmaceutical composition. Such a kit can also comprise instructions for the use thereof; the instructions can be tailored to the precise metabolic disorder being treated. The instructions can describe the use and nature of the materials provided in the kit. In certain embodiments, kits include instructions for a patient to carry out administration to treat a metabolic disorder, such as elevated glucose levels, elevated insulin levels, obesity, type 2 diabetes, dyslipidemia or diabetic nephropathy.

Instructions can be printed on a substrate, such as paper or plastic, etc, and can be present in the kits as a package insert, in the labeling of the container of the kit or components thereof (e.g., associated with the packaging), etc. In other embodiments, the instructions are present as an electronic storage data file present on a suitable computer readable storage medium, e.g. CD-ROM, diskette, etc. In yet other embodiments, the actual instructions are not present in the kit, but means for obtaining the instructions from a remote source, such as over the internet, are provided. An example of this embodiment is a kit that includes a web address where the instructions can be viewed and/or from which the instructions can be downloaded.

Often it will be desirable that some or all components of a kit are packaged in suitable packaging to maintain sterility. The components of a kit can be packaged in a kit containment element to make a single, easily handled unit, where the kit containment element, e.g., box or analogous structure, may or may not be an airtight container, e.g., to further preserve the sterility of some or all of the components of the kit.

EXAMPLES

The following examples, including the experiments conducted and results achieved, are provided for illustrative purposes only and are not to be construed as limiting the present invention.

Example 1

Preparation of Fc-GDF15 Molecules

GDF15 fusions with knob/holeFc, HemiFc, charged pair (delHinge) Fc and charged pair (delHinge) cysteine clamp Fc sequences were stably expressed in serum free, suspension adapted CHO-K1 cell line. GDF15-Fc molecules were cloned into a stable expression vector containing puromycin resistance while the Fc chains were cloned into a hygromycin containing expression vector (Selexis, Inc.). The plasmids were transfected at a 1:1 ratio using lipofectamine LTX and cells were selected 2 days post transfection in a proprietary growth media containing 10 ug/mL puromycin and 600 ug/mL hygromycin. Media was exchanged 2 times per week during selection. When cells reached about 90% viability, they were scaled up for a fedbatch production run. Cells were seeded at 1e6/mL in a proprietary production media and fed on days 3, 6, and 8. The conditioned medium (CM)

produced by the cells was harvested on day 10 and clarified. Endpoint viabilities typically were above 90%.

The Fc-GDF15 clarified, conditioned media was purified using a two-step chromatography procedure. Approximately 5 L of the CM was applied directly to a GE MabSelect SuRe column that had previously been equilibrated with Dulbecco's Phosphate Buffered Saline (PBS). The bound protein underwent three wash steps: first, 3 column volumes (CV) of PBS; next, 1 CV of 20 mM Tris, 100 mM sodium chloride, pH 7.4; and finally, 3 CV of 500 mM L-arginine, pH 7.5. These wash steps remove unbound or lightly bound media components and host cell impurities. The column was then re-equilibrated with 5 CV of 20 mM Tris, 100 mM sodium chloride at pH 7.4 which brings the UV absorbance back to baseline. The desired protein was eluted with 100 mM acetic acid at pH 3.6 and collected in bulk. The protein pool was quickly titrated to within a pH range of 5.0 to 5.5 with 1 M Tris-HCl, pH 9.2.

The pH adjusted protein pool was next loaded onto a GE SP Sepharose HP column that had been previously equilibrated with 20 mM MES at pH 6.0. The bound protein was then washed with 5 CV of equilibration buffer, and finally eluted over a 20 CV, 0 to 50% linear gradient from 0 to 400 mM sodium chloride in 20 mM MES at pH 6.0. Fractions were collected during the elution and analyzed by analytical size-exclusion chromatography (Superdex 200) to determine the appropriate fractions to pool for a homogeneous product. The SP HP chromatography removes product-related impurities such as free Fc, clipped species, and Fc-GDF15 multimers.

The SP HP pool was then buffer exchanged into 10 mM sodium acetate, 5% proline, pH 5.2 by dialysis. It was concentrated to approximately 15 mg/ml using the Sartorius Vivaspin 20 Ten kilo-Dalton molecular weight cut-off centrifugal device. Finally, it was sterile filtered and the resulting solution containing the purified Fc-GDF15 molecules is stored at 5° C. Final products were assessed for identity and purity using mass spectral analysis, sodium dodecyl sulfate polyacrylamide electrophoresis and size exclusion high performance liquid chromatography.

The purification method described above was employed to purify DhMonoFc-GDF15 fusion proteins. However, it was found that the addition of the H6D mutation to the DhMonoFc-GDF15 caused soluble aggregates to form in the SP elution. Therefore, the purification of the DhMonoFc-GFF15(H6D) included an additional SEC step (Superdex 200 with 20 mM phosphate, 250 mM NaCl, pH 6.8), followed by loading on Q-sepharose HP and eluting with a gradient from 0 to 0.6M NaCl in 20 mM tris, pH 8.5.

Example 2

Preparation of GDF15-HSA and DhMonoFc Molecules

GDF15 fusions with HSA and DhMonoFc sequences were stably expressed in CHO-S cells (Invitrogen). For each of the constructs producing homodimers, the coding sequence was cloned into stable expression vector containing puromycin resistance (Selexis, Inc.). In the case of the HSA-$(G_4S)_4$-GDF15:GDF15 heterodimer, the HSA-$(G_4S)_4$-GDF15 fusion sequence was cloned into an expression vector containing puromycin resistance and the GDF15 sequence was cloned into an expression vector containing hygromycin resistance. CHO-S parental cells were maintained in CD-CHO medium (Invitrogen) supplemented with 8 mM L-glutamine and were transfected with 4 µg of plasmid DNA using a Lipofectamine LTX transfection kit (Invitrogen) according to the manufacturer's instructions. In the case of the HSA-$(G_4S)_4$-GDF15:GDF15 heterodimer, the two plasmids were mixed at a 1:1 ratio prior to transfection. Stable cell lines were selected using 10 µg/mL of puromycin (homodimers) or 10 µg/mL of puromycin plus 400 µg/mL hygromycin (heterodimer). Upon recovery, which was defined as >90% viability using a Vi-Cell counter (Beckman Coulter), the stable CHO-S cell lines were expanded and used to seed either batch productions in shake flasks or fedbatch productions in WAVE bioreactors (GE Healthcare). Both processes were seeded at 1e6 viable cells/mL in production medium. Batch productions were harvested by centrifugation on day 6, while fedbatch productions were fed on days 3, 6, and 8. The CM produced by the cells was harvested by centrifugation on day 10 and clarified.

The HSA-GDF15 fusion proteins were purified from clarified conditioned media using two chromatographic steps. The clarified conditioned media containing the HSA-GDF15 fusion protein was applied to a Cibracon Blue Sepharose HP column that is equilibrated with 20 mM Phosphate, 150 mM NaCl pH 7.4. The column was next washed with equilibration buffer until a baseline ultraviolet (UV) level is obtained. Product and contaminants are eluted by a 20 mM Phosphate, 2M NaCl buffer and the elutions were collected and subsequently assayed by Coomasie-stained SDS-PAGE (sodium dodecyl sulfate polyacrylamide gel electrophoresis) to identify which eluate fractions contained a polypeptide that migrates at the predicted molecular weight of HSA-GDF15 fusion protein. Following the Blue Sepharose step, the pooled fractions containing product were dialyzed versus 10 mM tris, pH 8.0. The dialysis step allowed for the binding of HSA-GDF15 fusion protein when applied to anion exchange chromatographic resin. The final chromatography step was Q-Sepharose HP which applies a linear gradient (0 to 0.6M NaCl in 10 mM tris pH 8.0) to elute the bound fusion protein. The elution from the Q-Sepharose HP was collected as fractions and then assayed by SDS-PAGE and analytical size exclusion chromatography to determine the appropriate fractions to pool. LCMS and SDS-PAGE were run to confirm the identity of each protein. The resulting pool was buffer exchanged by dialysis into 10 mM Sodium Acetate, 9% sucrose pH 4.5, sterile filtered, and finally stored at 5 C or frozen.

DhMonoFc-GDF15 fusion proteins were purified as set forth above in Example 2 for other Fc-GDF15 fusion proteins.

Example 3

Suppression of Food Intake in Hyperphagic Ob/Ob Mice by Fc Fusion GDF15 Polypeptides and HSA Fusion GDF15 Polypeptides GDF15 reduces food intake in hyperphagic ob/ob mice, and a food intake assay was used to evaluate efficacy of different forms of GDF15 analogs. As the half-life of human GDF15 polypeptide in mouse was observed to be approximately 3 hours, an Fc fusion strategy was used to extend protein half-life. Various multimers comprising a polypeptide comprising a GDF15 region were generated and analyzed for in vivo activity, by introducing the multimer into hyperphagic leptin-deficient ob/ob mice, and measuring the ability of a particular multimer comprising a polypeptide comprising a GDF15 region to suppress food intake in these animals. The multimer comprising a polypeptide comprising a GDF15 region to be tested was injected subcutaneously into a 7-8 week old ob/ob mouse (Jackson Laboratory) between 4-5 pm on day 0. Animals were transferred after injection to cages where food had been premeasured, and food intake was measured between 9-10 AM the next day.

The results of representative experiments are provided in FIGS. 6-53. These experiments demonstrate that the described multimers comprising GDF15 regions exhibit a decrease in food intake in ob/ob mice, with greater potency than those of native mature hGDF15 homodimer.

Example 4

Chronic Efficacy of GDF15 Constructs in DIO Mice

Certain multimers comprising GDF15 regions are administered chronically and subcutaneously into DIO mice, once per week. The constructs demonstrate efficacy in improving various metabolic parameters, including body weight, blood glucose levels and glucose tolerance, serum insulin levels, serum cholesterol levels, serum triglyceride levels and oral lipid tolerance.

Example 5

In Vivo Activity of GDF15 Constructs

Male C57Bl/6 were fed a 60% high fat diet for 15 weeks and divided into different treatment groups for each group to have the same pretreatment body weight, glucose, insulin, triglyceride and cholesterol levels. Animals were subcutaneously dosed with proteins or vehicle buffer weekly for 5 weeks. Three different dose levels were selected for the proteins: 10, 1, 0.1 nmol/kg, which are equivalent to 1.25, 0.125, 0.0125 mg/kg. Studies were carried for 5 weeks, with the last dose on day 28.

Body weight was measured weekly during the 5 weeks of treatment and drug washout. One oral glucose tolerance tests (OGTT) was performed 2 weeks after the first protein injection in animals fasted for 4 hours. Another oral glucose tolerance tests (OGTT) was performed 5 weeks after the first protein injection in animals fasted for 16 hours. In OGTT, animals were orally administered with 2 g/kg glucose solution, and glucose levels were measured by AlphaTRAK glucometer (Abbott) at 0, 15, 30, 60, 120 min. Area under the curve (AUC) of the glucose levels during the OGTT were calculated to compare glucose tolerance of different treatment groups. Serum samples were collected at 3 weeks after first protein injection and used to measure insulin, triglyceride and cholesterol levels, as well as the levels of test articles. Insulin levels were measured using immunoassay kit (Alpco). Triglyceride and cholesterol levels were measured using enzymatic assays (Wako).

Figure 57:
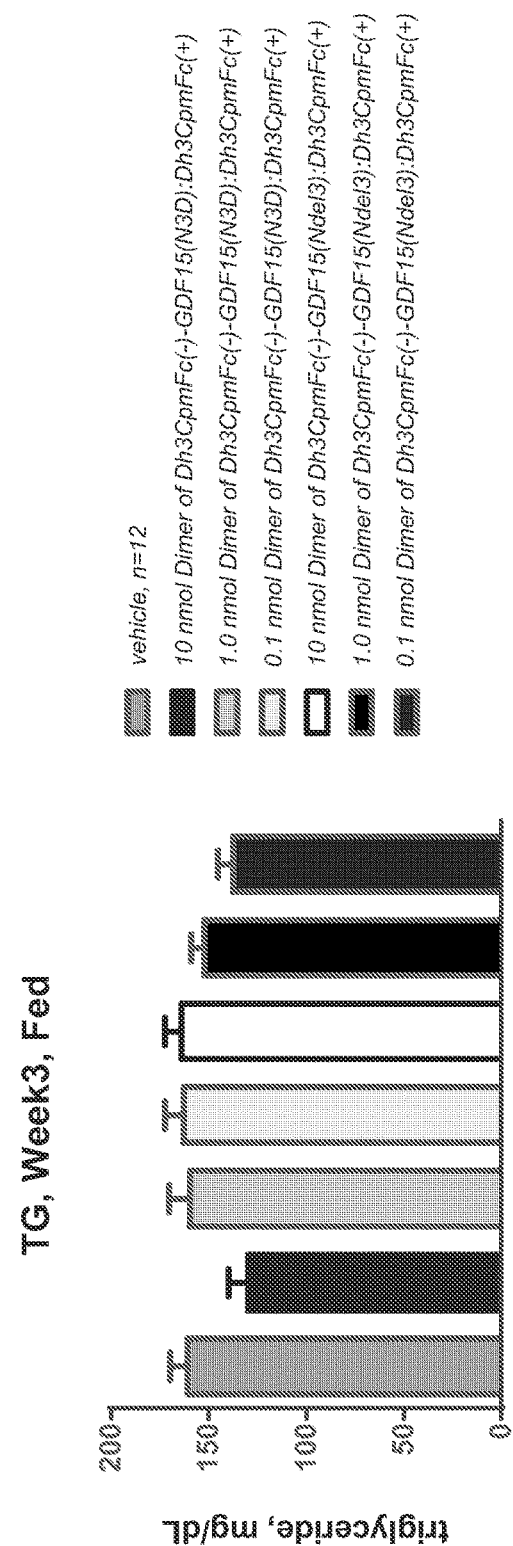
FIG. 57 is a bar graph of triglycerides (mg/mL) (fed) at week 3 of treatment with (a) vehicle (b) 10 mmol of a dimer of the Dh3CpmFc(−)-GDF15(N3D):Dh3CpmFc(+) heterodimer (c) 1 mmol of a dimer of the Dh3CpmFc(−)-GDF15(N3D):Dh3CpmFc(+) heterodimer, (d) 0.1 mmol of a dimer of the Dh3CpmFc(−)-GDF15(N3D):Dh3CpmFc(+) heterodimer, (e) 10 mmol of a dimer of the Dh3CpmFc(−)-GDF15(Ndel3):Dh3CpmFc(+) heterodimer (g) 1 mmol of a dimer of the Dh3CpmFc(−)-GDF15(Ndel3):Dh3CpmFc(+) heterodimer, or (g) 0.1 mmol of a dimer of the Dh3CpmFc(−)-GDF15(Ndel):Dh3CpmFc(+) heterodimer.
Figure 58:
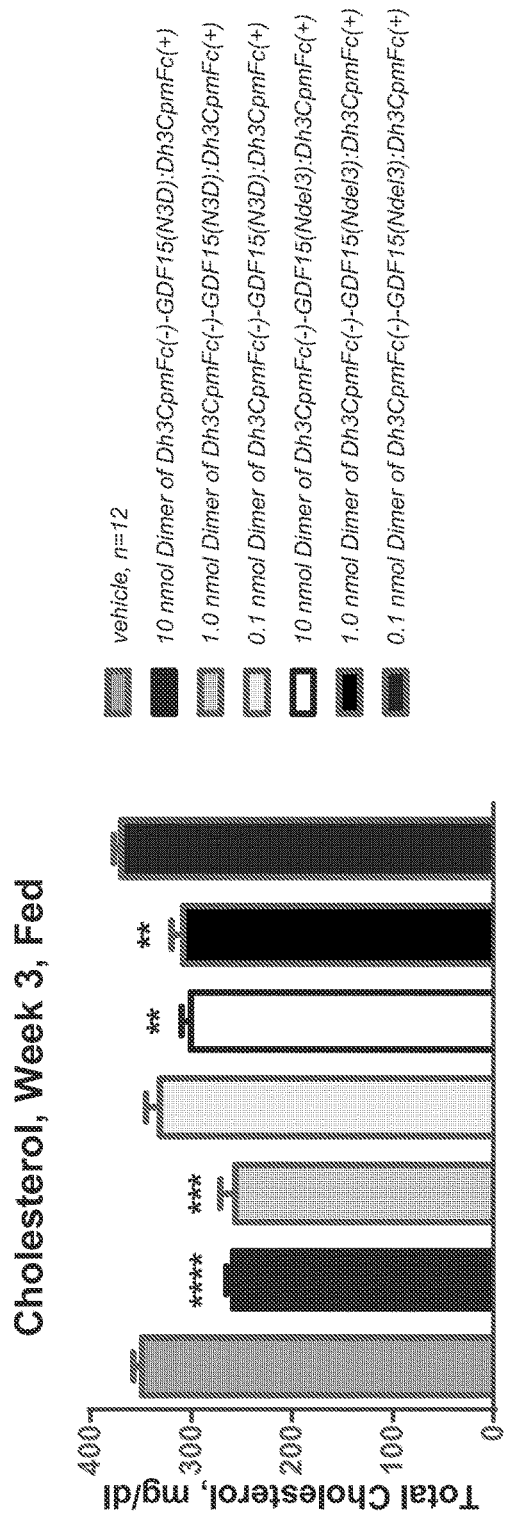
FIG. 58 is a bar graph of cholesterol (mg/mL) (fed) at week 3 of treatment with (a) vehicle (b) 10 mmol of a dimer of the Dh3CpmFc(−)-GDF15(N3D):Dh3CpmFc(+) heterodimer (c) 1 mmol of a dimer of the Dh3CpmFc(−)-GDF15(N3D):Dh3CpmFc(+) heterodimer, (d) 0.1 mmol of a dimer of the Dh3CpmFc(−)-GDF15(N3D):Dh3CpmFc(+) heterodimer, (e) 10 mmol of a dimer of the Dh3CpmFc(−)-GDF15(Ndel3):Dh3CpmFc(+) heterodimer (g) 1 mmol of a dimer of the Dh3CpmFc(−)-GDF15(Ndel3):Dh3CpmFc(+) heterodimer, or (g) 0.1 mmol of a dimer of the Dh3CpmFc(−)-GDF15(Ndel):Dh3CpmFc(+) heterodimer.
Figure 59:
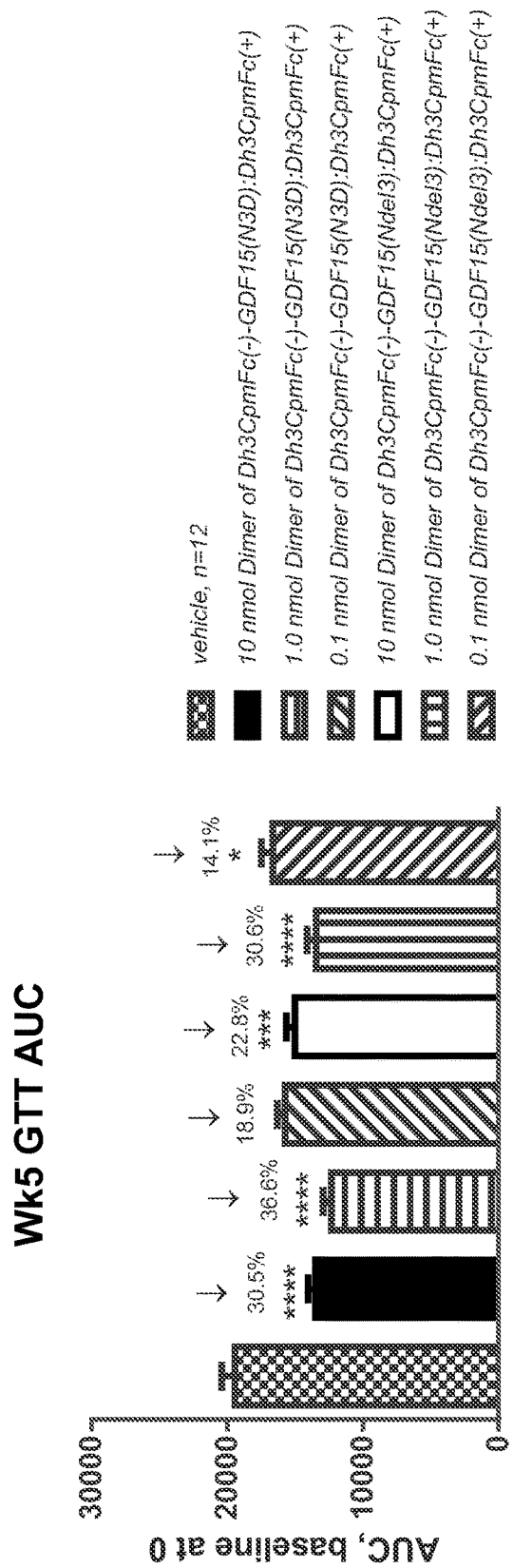
FIG. 59 is a bar graph of area under the curve (AUC) for a glucose tolerance test at week 5 of treatment with (a) vehicle (b) 10 mmol of a dimer of the Dh3CpmFc(−)-GDF15(N3D):Dh3CpmFc(+) heterodimer (c) 1 mmol of a dimer of the Dh3CpmFc(−)-GDF15(N3D):Dh3CpmFc(+) heterodimer, (d) 0.1 mmol of a dimer of the Dh3CpmFc(−)-GDF15(N3D):Dh3CpmFc(+) heterodimer, (e) 10 mmol of a dimer of the Dh3CpmFc(−)-GDF15(Ndel3):Dh3CpmFc(+) heterodimer (g) 1 mmol of a dimer of the Dh3CpmFc(−)-GDF15(Ndel3):Dh3CpmFc(+) heterodimer, or (g) 0.1 mmol of a dimer of the Dh3CpmFc(−)-GDF15(Ndel):Dh3CpmFc(+) heterodimer.

The results are shown in FIGS. 54-59 (asterisks indicate statistical significance). These experiments demonstrate that the described multimers comprising GDF15 regions reduce AUC of the glucose levels during the OGTT (FIGS. 55 and 59), reduce body weight (FIG. 54) reduce insulin levels (FIG. 56), reduce cholesterol (FIG. 58) and reduce triglycerides (FIG. 57).

Example 6

Thermal Stability of GDF15 Constructs

The thermal stability of the selected GDF15 constructs was assessed by differential scanning calorimetry on a MicroCal Capillary VP-DSC system in which temperature differences between the reference and sample cell are continuously measured, and calibrated to power units. This data channel is referred to as the DP signal, or the differential power between the reference and sample cell. The unfolding of a protein molecule appears as an endothermic transition on the DSC thermogram and can characterized by the thermal transition midpoints (Tm). The samples were heated from 10° C. to 100° C. at a heating rate of 60° C./hour. The pre-scan time was 15 minutes and the filtering period was 10 seconds. The concentrations used in the DSC experiments were around 1.0 mg/mL. The data analysis for baseline correction and determination of Tm values was done using MicroCal Origin 7 software.

In particular, a dimer of DhCpmFc(−)-GDF15(N3D): DhCpmFc(+) was compared to a dimer of Dh3CpmFc(−)-GDF15(N3D):DhCpmFc(+); a dimer of DhCpmFc(−)-GDF15(Ndel3):DhCpmFc(+) was compared to a dimer of Dh3CpmFc(−)-GDF15(Ndel3):DhCpmFc(+); a dimer of DhCpmFc(−)(Y349C)-GDF15(N3D):DhCpmFc(+)(S354C) was compared to a dimer of Dh3CpmFc(−)(Y349C)-GDF15(N3D):DhCpmFc(+)(S354C); and a dimer of DhCpmFc(−)(Y349C)-GDF15(Ndel3):DhCpmFc(+)(S354C) was compared to a dimer of Dh3CpmFc(−)(Y349C)-GDF15(Ndel3): DhCpmFc(+)(S354C). The results are shown in FIG. 61. These experiments demonstrate that the "Dh3CpmFc" domains confer greater stability than the corresponding "DhCpmFc" domains.

Example 7

Fcγ Receptor Binding Analysis

Selected GDF15 constructs were analyzed for their binding activity to Fcγ receptors on BIA3000. Each Fcγ receptor was captured on anti-his antibody coated CM5 surface (captured RL~200 RU). The GDF15 constructs were diluted to 250 nM in sample buffer (0.1 mg/ml BSA, 0.005% P20, PBS). Each GDF15 construct was injected over anti-his antibody captured Fcγ receptor surfaces at 50 μL/min for 3 minutes. After a 5-minute dissociation in instrument running buffer (0.005% P20 in PBS), each Fcγ receptor surface was regenerated by an injection of 8 mM Glycine, pH1.5, 1M NaCl for 30 seconds, followed by an injection of 10 mM Glycine, pH1.5 for 30 seconds. The resulting sensorgrams were analyzed using BIAcore BIAEvaluation (v. 4.1). The binding response in the unit of RU was read at 10 seconds before end of injection.

Figure 60:
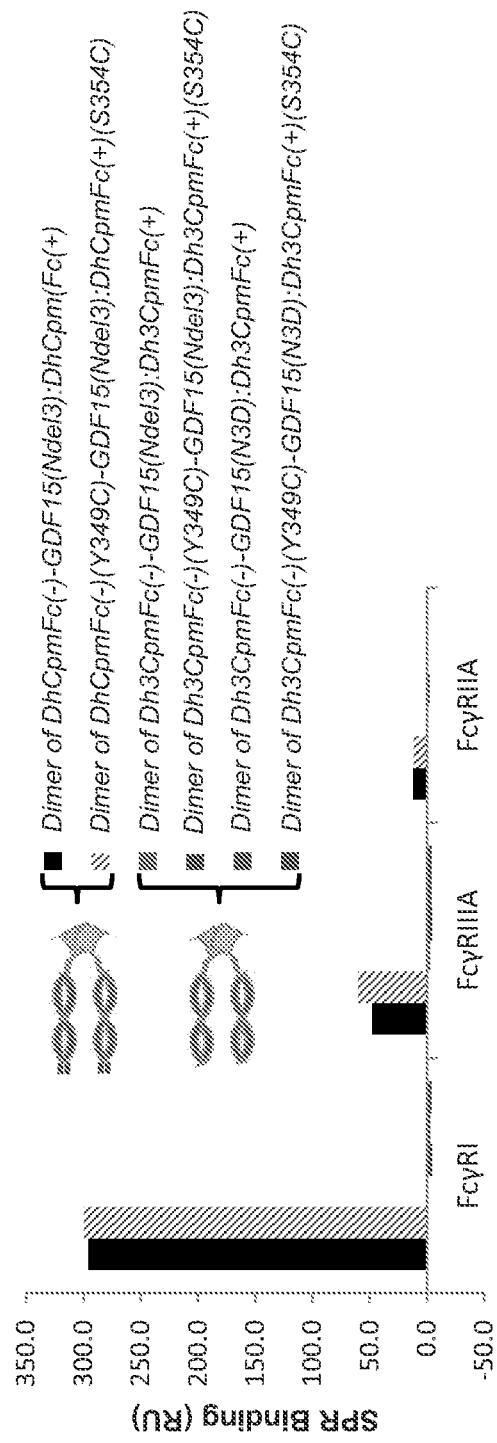
FIG. 60 is a bar graph showing SPR Binding (RU) with respect to FcγRI, FcγRIIIA and FcγRIIA for (a) a dimer of DhCpmFc(−)-GDF15(Ndel3):DhCpmFc(+), (b) a dimer of DhCpmFc(−)(Y349C)-GDF15(Ndel3):DhCpmFc(+)(S354C); (c) a dimer of Dh3CpmFc(−)-GDF15(Ndel3); (d) a dimer of Dh3CpmFc(−)(Y349C)-GDF15(Ndel3)-Dh3CpmFc(+)(S354C); (e) a dimer of Dh3CpmFc(−)-GDF15(N3D); and (f) a dimer of Dh3CpmFc(−)(Y349C)-GDF15(N3D):Dh3CpmFc(+)(S354C) (from left to right with respect to each receptor).

In particular, FcγRI, FcγRIIIA and FcγRIIA were determined with respect to a dimer of DhCpmFc(−)-GDF15 (Ndel3):DhCpmFc(+), a dimer of DhCpmFc(−)(Y349C)-GDF15(Ndel3):DhCpmFc(+)(S354C); a dimer of Dh3CpmFc(−)-GDF15(Ndel3); a dimer of Dh3CpmFc(−)(Y349C)-GDF15(Ndel3)-Dh3CpmFc(+)(S354C); a dimer of Dh3CpmFc(−)-GDF15(N3D); and a dimer of Dh3CpmFc (−)(Y349C)-GDF15(N3D):Dh3CpmFc(+)(S354C). The results are shown in FIG. 60. These experiments demonstrate that the "Dh3CpmFc" domains essentially eliminate FcγRI, FcγRIIIA and FcγRIIA binding.

While the present invention has been described in terms of various embodiments, it is understood that variations and modifications will occur to those skilled in the art. Therefore, it is intended that the appended claims cover all such equivalent variations that come within the scope of the invention as claimed. In addition, the section headings used herein are for organizational purposes only and are not to be construed as limiting the subject matter described.

All references cited in this application are expressly incorporated by reference herein for any purpose.

SEQUENCE LISTING (305 sequences)

SEQ ID NO: 1 - protein, 4 aa, Artificial Sequence
  source: /note="Description of Artificial Sequence: Synthetic peptide"
RGRR

SEQ ID NO: 2 - protein, 7 aa, Artificial Sequence
  source: /note="Description of Artificial Sequence: Synthetic peptide"
RGRRRAR

SEQ ID NO: 3 - DNA, 927 bp, Homo sapiens
atgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 4 - protein, 308 aa, Homo sapiens
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 5 - DNA, 912 bp, Mus sp.
atggccccgcccgcgctccaggcccagcctccaggcggctctcaactgaggttcctgctgttcctgctgctgttgctgctgctgctgtcatggccatcgcagggggacgccctggcaatgcctgaacagcgaccctccggccctgagtcccaactcaacgccgacgagctacggggtcgcttccaggacctgctgagccggctgcatgccaaccagagccgagaggactcgaactcagaaccaagtcctgacccagctgtccggatactcagtccagaggtgagattggggtcccacggccagctgctactccgcgtcaaccgggcgtcgctgagtcagggtctccccgaagcctaccgcgtgcaccgagcgctgctcctgctgacgccgacggcccgcccctgggacatcactaggcccctgaagcgtgcgctcagcctccggggaccccgtgctcccgcattacgcctgcgcctgacgccgcctccggacctggctatgctgccctctggcggcacgcagctggaactgcgcttacgggtagccgccggcagggggcgccgaagcgcgcatgcgcacccaagagactcgtgcccactgggtccggggcgctgctgtcacttggagactgtgcaggcaactcttgaagacttgggctggagcgactgggtgctgtccccgcgccagctgcagctgagcatgtgcgtgggcgagtgtccccacctgtatcgctccgcgaacacgcatgcgcagatcaaagcacgcctgcatggcctgcagcctgacaaggtgcctgccccgtgctgtgtcccctccagctacaccccggtggttcttatgcacaggacagacagtggtgtgtcactgcagacttatgatgacctggtggcccggggctgccactgcgcttga

SEQ ID NO: 6 - protein, 303 aa, Mus sp.
MAPPALQAQPPGGSQLRFLLFLLLLLLLLSWPSQGDALAMPEQRPSGPESQLNADELRGRFQDLLSRLHANQSREDSNSEPSPDPAVRILSPEVRLGSHGQLLLRVNRASLSQGLPEAYRVHRALLLLTPTARPWDITRPLKRALSLRGPRAPALRLRLTPPPDLAMLPSGGTQLELRLRVAAGRGRRSAHAHPRDSCPLGPGRCCHLETVQATLEDLGWSDWVLSPRQLQLSMCVGECPHLYRSANTHAQIKARLHGLQPDKVPAPCCVPSSYTPVVLMHRTDSGVSLQTYDDLVARGCHCA

SEQ ID NO: 7 - DNA, 840 bp, Homo sapiens
ctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 8 - protein, 279 aa, Homo sapiens
LSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 9 - DNA, 816 bp, Mus sp.
tcgcagggggacgccctggcaatgcctgaacagcgaccctccggccctgagtcccaactcaacgccgacgagctacggggtcgcttccaggacctgctgagccggctgcatgccaaccagagccgagaggactcgaactcagaaccaagtcctgacccagctgtccggatactcagtccagaggtgagattggggtcccacggccagctgctactccgcgtcaaccgggcgtcgctgagtcagggtctccccgaagcctaccgcgtgcaccgagcgctgctcctgctgacgccgacggcccgcccctgggacatcactaggcccctgaagcgtgcgctcagcctccggggaccccgtgctcccgcattacgcctgcgcctgacgccgcctccggacctggctatgctgccctctggcggcacgcagctggaactgcgcttacgggtagccgccggcagggggcgccgaagcgcgcatgcgcacccaagagactcgtgcccactgggtccggggcgctgctgtcacttggagactgtgcaggcaactcttgaagacttgggctggagcgactgggtgctgtccccgcgccagctgcagctgagcatgtgcgtgggcgagtgtccccacctgtatcgctccgcgaacacgcatgcgcagatcaaagcacgcctgcatggcctgcagcctgacaaggtgcctgccccgtgctgtgtcccctccagctacaccccggtggttcttatgcacaggacagacagtggtgtgtcactgcagacttatgatgacctggtggcccggggctgccactgcgcttga

SEQ ID NO: 10 - protein, 271 aa, Mus sp.
SQGDALAMPEQRPSGPESQLNADELRGRFQDLLSRLHANQSREDSNSEPSPDPAVRILSPEVRLGSHGQLLLRVNRASLSQGLPEAYRVHRALLLLTPTARPWDITRPLKRALSLRGPRAPALRLRLTPPPDLAMLPSGGTQLELRLRVAAGRGRRSAHAHPRDSCPLGPGRCCHLETVQATLEDLGWSDWVLSPRQLQLSMCVGECPHLYRSANTHAQIKARLHGLQPDKVPAPCCVPSSYTPVVLMHRTDSGVSLQTYDDLVARGCHCA

SEQ ID NO: 11 - DNA, 339 bp, Homo sapiens
gcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 12 - protein, 112 aa, Homo sapiens
ARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 13 - DNA, 351 bp, Artificial Sequence
  source: /note="Description of Artificial Sequence: Synthetic polynucleotide"
atgagcgcgcatgcgcacccaagagactcgtgcccactgggtccggggcgctgctgtcacctggagactgtgcaggcaactcttgaagacttgggctggagcgactgggtgttgtccccgcgccagctgcagctgagcatgtgcgtgggcgagtgtccccacctgtatcgctccgcgaacacgcatgcgcagatcaaagcacgcctgcatggcctgcagcctgacaaggtgcctgccccgtgctgtgtcccctccagctacaccccggtggttcttatgcacaggacagacagtggtgtgtcactgcagacttatgatgacctggtggcccggggctgccactgcgcttga

SEQ ID NO: 14 - protein, 116 aa, Artificial Sequence
  source: /note="Description of Artificial Sequence: Synthetic polypeptide"
MSAHAHPRDSCPLGPGRCCHLETVQATLEDLGWSDWVLSPRQLQLSMCVGECPHLYRSANTHAQIKARLHGLQPDKVPAPCCVPSSYTPVVLMHRTDSGVSLQTYDDLVARGCHCA

SEQ ID NO: 15 - protein, 12 aa, Artificial Sequence
  source: /note="Description of Artificial Sequence: Synthetic peptide"
ERKSSVECPPCP

SEQ ID NO: 16 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 17 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 18 - protein, 20 aa, Artificial Sequence
  source: /note="Description of Artificial Sequence: Synthetic peptide"
GGGGSGGGGSGGGGSGGGGS

SEQ ID NO: 19 - DNA, 1047 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcggaggtggtggatctggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 20 - protein, 348 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 21 - DNA, 654 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgagctgcgcggtcaaaggcttctatcccagcgacatcgccgtggagtgggagagcaatgggcagccggagaacaactacaagaccacgcctcccgtgctggactccgacggctccttcttcctcgtcagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 22 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 23 - DNA, 1046 bp, Artificial Sequence
  source: /note="Description of Artificial Sequence: Synthetic polynucleotide"
cacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcggaggtggtggatctggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 24 - protein, 348 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 25 - protein, 112 aa, Artificial Sequence
  source: /note="Description of Artificial Sequence: Synthetic polypeptide"
ARNGDDCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 26 - DNA, 1047 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcggaggtggtggatctggaggcggtggaagcgcgcgcaacggagacgactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 27 - protein, 348 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSGGGGSGGGGSARNGDDCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 28 - protein, 230 aa, Artificial Sequence
  source: /note="Description of Artificial Sequence: Synthetic polypeptide"
GGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 29 - protein, 227 aa, Artificial Sequence
  source: /note="Description of Artificial Sequence: Synthetic polypeptide"
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 30 - protein, 21 aa, Artificial Sequence
  source: /note="Description of Artificial Sequence: Synthetic peptide"
SGGGGSGGGGSGGGGSGGGGS

SEQ ID NO: 31 - DNA, 1833 bp, Artificial Sequence
  source: /note="Description of Artificial Sequence: Synthetic polynucleotide"
ggaggtggagagcgcaaatcttctgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaaaccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggaggtggcggtagcggtggcggaggttcaggtggcggcggaagcggtggaggaggttcagagcggaaatccagcgttgaatgtcctccgtgccctgctccacccgtcgcggggcctagtgtcttccttttccctccaaaaccaaaggatacactgatgatcagccggacccccgaggttacgtgcgtcgtcgtcgatgtctcccacgaggatccagaggtccaattcaactggtacgtggacggggtcgaggtgcataatgcaaagacaaagccacgggaagagcagtttaactctactttccgcgtggtttctgtgctgaccgtggtgcaccaagattggctcaacggcaaggagtacaagtgcaaggtaagcaataaggggctccctgcccccattgagaagactatctccaagacaaagggacagccacgcgagccacaagtctatacactccccccttcccgcgaagaaatgaccaagaatcaggttagcctgacatgcttggttaagggtttctacccctctgacatagccgtggagtgggagagcaatggacaaccagagaacaactacaagaccaccccacccatgctggatagcgacggttcattctttctgtatagtaagcttaccgtggacaagtcccggtggcaacaaggaaatgtcttttcatgctctgtgatgcacgaggccttgcataatcactatactcagaagagcttgagcctcagccccggatctggaggtggcggatccgggggcggtggaagcggaggtggtggatcgggaggcggtggaagcgcgcgcaacggcgaccactgtccgctcgggcccggacgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 32 - protein, 610 aa, Artificial Sequence
  source: /note="Description of Artificial Sequence: Synthetic polypeptide"
GGGERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 33 - protein, 218 aa, Artificial Sequence
  source: /note="Description of Artificial Sequence: Synthetic polypeptide"
GGGAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 34 - protein, 25 aa, Artificial Sequence
  source: /note="Description of Artificial Sequence: Synthetic peptide"
GGGGSGGGGSGGGGSGGGGSGGGGS

SEQ ID NO: 35 - protein, 215 aa, Artificial Sequence
  source: /note="Description of Artificial Sequence: Synthetic polypeptide"
APPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 36 - DNA, 1809 bp, Artificial Sequence
  source: /note="Description of Artificial Sequence: Synthetic polynucleotide"
ggcggtggagctccgccggtggctggaccctcagtgttcctctttccaccgaagccgaaggacacccttatgattagccggaccccagaggtcacttgcgtcgtcgtggacgtgtcccatgaggatcccgaagtgcagtttaactggtatgtggacggagtggaggtccataacgccaagaccaagccaagggaagaacagttcaatagcaccttccgggtggtgtccgtgctcaccgtggtgcatcaagactggctgaatggcaaagagtacaaatgtaaggtgtcaaacaaggggctcccagcccctattgaaaagaccatctcaaagactaagggacagccacgcgaacctcaagtgtataccctcccgccttcacgcgaagaaatgactaagaatcaggtcagccttacttgtctggtcaagggcttctacccgagcgacattgcagtcgaatgggagagcaatggtcagccagagaataactacaagaccactcctcccatgcttgatagcgatggaagctttttcctttacagcaagcttactgtggataagtctcgctggcaacagggaaatgtgttcagctgttcagtgatgcatgaagcactccacaatcattacacccagaagtcactcagcctctcacccggaggaggaggcggttctggtggaggagggtctggaggtggagggagcggcggaggcgggtctggcggtggtgggtctgagaggaagtcatcagtggaatgcccaccatgccctgctcctcccgtggccggtccgagcgtgtttctcttcccacctaagcccaaggacactctgatgatctcacggactccggaagtgacttgtgtggtggtggacgtgtctcatgaggaccctgaagtgcagttcaactggtacgtggacggcgtggaggtgcacaatgctaagaccaagcctagagaggaacagttcaattccacctttcgcgtggtgagcgtcctgaccgtcgtgcaccaggactggcttaacggaaaggaatacaagtgcaaggtgtccaacaaaggccttccagctcccattgagaaaaccatctctaaaactaagggtcaaccaagggaaccccaagtctacaccctccctccgtctagagaagagatgaccaaaaaccaggtgtccctgacctgtctggtgaagggattttacccctcagacatcgccgtggagtgggaaagcaacggacagcccgaaaacaactataagactacccctcctatgctggactcagacggatctttcttcctctatagcaagctcactgtggacaaatccagatggcaacaagggaatgtgttctcatgcagcgtgatgcacgaggctcttcacaaccactatacccagaagagcctgtctctttcacctggttccggaggtggtgggagcggagggggtggatcaggtggtggagggtccggaggcggaggatccgcacggaatggcgaccactgtccactgggacccggaagatgttgtcgcctccacaccgtgagggcctctctggaggaccttggctgggccgactgggtcctgtcacctcgggaggtccaagtcaccatgtgtatcggagcctgccccagccaattcagagcagcaaatatgcacgcacagattaagaccagcctgcatcggcttaaacctgatactgtgccggctccttgttgcgtgccagcatcttacaacccgatggtgctgatccagaaaaccgataccggtgtctccctccagacttacgacgacctccttgcaaaggactgccattgcatc

SEQ ID NO: 37 - protein, 591 aa, Artificial Sequence
  source: /note="Description of Artificial Sequence: Synthetic polypeptide"
GGGAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGGGGGSGGGGSGGGGSGGGGSGGGGSAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGSGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 38 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 39 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 40 - protein, 23 aa, Artificial Sequence
  source: /note="Description of Artificial Sequence: Synthetic peptide"
GSGSATGGSGSVASSGSGSATHL

SEQ ID NO: 41 - DNA, 1053 bp, Artificial Sequence
  source: /note="Description of Artificial Sequence: Synthetic polynucleotide"
gccccagagctgcttggtggaccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacaatagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgagcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtcacctggcggatccggttctgctactggtggttccggctccgtcgcaagctctggttcaggcagtgcgactcatctggcacggaacggggaccattgtcccctgggacctggtcggtgctgccggcttcacaccgtcagagcctctctggaggaccttggatgggctgattgggtgctgagccctcgggaggtgcaagtcaccatgtgcatcggggcctgccctagccagttccgcgcagccaacatgcacgctcagatcaaaacctctcttcacagactgaagcccgacaccgtgccagcaccttgctgtgtgccggcctcttataaccccatggtcctcattcagaaaaccgacaccggagtgtcacttcagacttacgatgacctcctggccaaggactgccactgcata

SEQ ID NO: 42 - protein, 351 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGSGSATGGSGSVASSGSGSATHLARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 43 - DNA, 651 bp, Artificial Sequence
  source: /note="Description of Artificial Sequence: Synthetic polynucleotide"
gcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtataccctgccgccgagccgcgaagaaatgaccaaaaaccaggtgagcctgacctgcctggtgaaaggcttttatccgagcgatattgcggtggaatgggaaagcaacggccagccggaaaacaactatgataccaccccgccggtgctggatagcgatggcagcttttttctgtatagcgatctgaccgtggataaaagccgctggcagcagggcaacgtgtttagctgcagcgtgatgcatgaagcgctgcataaccattatacccagaaaagcctgagcctgagcccgggcaaa

SEQ ID NO: 44 - protein, 216 aa, Artificial Sequence; identical to SEQ ID NO: 22
  source: /note="Description of Artificial Sequence: Synthetic polypeptide"

SEQ ID NO: 45 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 46 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 47 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 48 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 49 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 50 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 51 - DNA, 654 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 52 - protein, 112 aa, Artificial Sequence
  source: /note="Description of Artificial Sequence: Synthetic polypeptide"
ARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 53 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 54 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 55 - protein, 109 aa, Artificial Sequence
  source: /note="Description of Artificial Sequence: Synthetic polypeptide"
GDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 56 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 57 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 58 - protein, 4 aa, Artificial Sequence
  source: /note="Description of Artificial Sequence: Synthetic peptide"
GGGG

SEQ ID NO: 59 - DNA, 996 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggagcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 60 - protein, 332 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 61 - protein, 5 aa, Artificial Sequence
  source: /note="Description of Artificial Sequence: Synthetic peptide"
GGGGS

SEQ ID NO: 62 - DNA, 1002 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 63 - protein, 333 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 64 - protein, 10 aa, Artificial Sequence
  source: /note="Description of Artificial Sequence: Synthetic peptide"
GGGGSGGGGS

SEQ ID NO: 65 - DNA, 1014 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 66 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 67 - DNA, 1014 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 68 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 69 - protein, 5 aa, Artificial Sequence
  source: /note="Description of Artificial Sequence: Synthetic peptide"
GGGGP

SEQ ID NO: 70 - DNA, 999 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacccgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 71 - protein, 333 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGPARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 72 - protein, 10 aa, Artificial Sequence
  source: /note="Description of Artificial Sequence: Synthetic peptide"
GGGGPGGGGP

SEQ ID NO: 73 - DNA, 1017 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacctggaggcggtggaccagcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 74 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGPGGGGPARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 75 - protein, 5 aa, Artificial Sequence
  source: /note="Description of Artificial Sequence: Synthetic peptide"
GGGGQ

SEQ ID NO: 76 - DNA, 1002 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcactgtggacaagagcaggtggcagcaggggaacgtcttctcatgctccgtgatgcatgaggctctgcacaaccactacacgcagaagagcctctccctgtctccgggtggaggtggtggacaggcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 77 - protein, 333 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGQARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 78 - protein, 10 aa, Artificial Sequence
  source: /note="Description of Artificial Sequence: Synthetic peptide"
GGGGQGGGGQ

SEQ ID NO: 79 - DNA, 1017 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacagggaggcggtggacaggcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 80 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGQGGGGQARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 81 - DNA, 1014 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacagggaggcggtggacaggcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 82 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGQGGGGQARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 83 - DNA, 1005 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacagggaggcggtggacagggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 84 - protein, 335 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGQGGGGQGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 85 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 86 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 87 - DNA, 984 bp, Artificial Sequence
  source: /note="Description of Artificial Sequence: Synthetic polynucleotide"
gccccagagctgcttggtggaccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacaatagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtcacctggcgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 88 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 89 - DNA, 651 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 90 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 91 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 92 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 93 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 94 - DNA, 651 bp, Artificial Sequence
  source: /note="Description of Artificial Sequence: Synthetic polynucleotide"
gccccagagctgcttggtggaccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacaatagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtctccgggtaaa

SEQ ID NO: 95 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 96 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 97 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 98 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 99 - DNA, 996 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggtggaggtggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 100 - protein, 332 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 101 - DNA, 1014 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 102 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 103 - DNA, 1014 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggacagggaggcggtggacaggcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 104 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGQGGGGQARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 105 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTCPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 106 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTCPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 107 - DNA, 1014 bp, Artificial Sequence
  source: /note="Description of Artificial Sequence: Synthetic polynucleotide"
gcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtataacagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtatacctgcccgccgagccgcgaagaaatgaccaaaaaccaggtgagcctgacctgcctggtgaaaggcttttatccgagcgatattgcggtggaatgggaaagcaacggccagccggaaaacaactatgataccaccccgccggtgctggatagcgatggcagcttttttctgtatagcgatctgaccgtggataaaagccgctggcagcagggcaacgtgtttagctgcagcgtgatgcatgaagcgctgcataaccattatacccagaaaagcctgagcctgagcccgggcggcggcggcggcagcggcggcggcggcagcgcgcgcaacggcgatcattgcccgctgggcccgggccgctgctgccgcctgcataccgtgcgcgcgagcctggaagatctgggctgggcggattgggtgctgagcccgcgcgaagtgcaggtgaccatgtgcattggcgcgtgcccgagccagtttcgcgcggcgaacatgcatgcgcagattaaaaccagcctgcatcgcctgaaaccggataccgtgccggcgccgtgctgcgtgccggcgagctataacccgatggtgctgattcagaaaaccgataccggcgtgagcctgcagacctatgatgatctgctggcgaaagattgccattgcatt

SEQ ID NO: 108 - protein, 338 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTCPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 109 - DNA, 651 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacacctgtcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 110 - protein, 585 aa, Artificial Sequence [sequence omitted]

SEQ ID NO: 111 - DNA, 2154 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggaggtggtggatccggaggcggtggaagcggaggtggtggatctggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 112 - protein, 717 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 113 - protein, 9 aa, Artificial Sequence
  source: /note="Description of Artificial Sequence: Synthetic peptide"
GSPAPAPGS

SEQ ID NO: 114 - DNA, 2121 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggatccccagctccagctccaggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 115 - protein, 706 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSPAPAPGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 116 - protein, 14 aa, Artificial Sequence
  source: /note="Description of Artificial Sequence: Synthetic peptide"
GSPAPAPPAPAPGS

SEQ ID NO: 117 - DNA, 2136 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggatccccagctccagctccacccgcacctgcccctggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 118 - protein, 711 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSPAPAPPAPAPGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 119 - protein, 11 aa, Artificial Sequence
  source: /note="Description of Artificial Sequence: Synthetic peptide"
GSAAQAAQQGS

SEQ ID NO: 120 - DNA, 2127 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggatccgccgctcaggctgcacagcaaggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 121 - protein, 708 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSAAQAAQQGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 122 - protein, 18 aa, Artificial Sequence
  source: /note="Description of Artificial Sequence: Synthetic peptide"
GSAAQAAQQAAQAAQQGS

SEQ ID NO: 123 - DNA, 2148 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggatccgccgctcaggctgcacagcaagcagcccaagcagctcagcagggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 124 - protein, 715 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSAAQAAQQAAQAAQQGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 125 - protein, 22 aa, Artificial Sequence
  source: /note="Description of Artificial Sequence: Synthetic peptide"
GGNAEAAAKEAAAKEAAAKAGG

SEQ ID NO: 126 - DNA, 2175 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggaggcaacgccgaggctgccgctaaggaagccgctgccaaggaggccgcagcaaaagaggctgcagctaaggccggaggagcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 127 - protein, 724 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGNAEAAAKEAAAKEAAAKEAAAKAGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 128 - protein, 30 aa, Artificial Sequence
  source: /note="Description of Artificial Sequence: Synthetic polypeptide"
GGGGSGGGGSGGGGSGGGGSGGGGSGGGGS

SEQ ID NO: 129 - DNA, 2184 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggaggtggtggctctggaggcggtggaagcggaggcggtggatccggaggcggtggaagcggaggtggtggatctggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatga

SEQ ID NO: 130 - protein, 777 aa, Artificial Sequence [sequence omitted]

SEQ ID NO: 131 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 132 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 133 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 134 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 135 - DNA, 654 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 136 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 137 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 138 - DNA, 996 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggagcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 139 - protein, 332 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 140 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 141 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 142 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 143 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 144 - DNA, 651 bp, Artificial Sequence
  source: /note="Description of Artificial Sequence: Synthetic polynucleotide"
gccccagagctgcttggtggaccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacgggagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtctccgggtaaa

SEQ ID NO: 145 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 146 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 147 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTCPPSREEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 148 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTCPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 149 - DNA, 984 bp, Artificial Sequence
  source: /note="Description of Artificial Sequence: Synthetic polynucleotide"
gcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtatggcagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtatacctgcccgccgagccgcaaagaaatgaccaaaaaccaggtgagcctgacctgcctggtgaaaggcttttatccgagcgatattgcggtggaatgggaaagcaacggccagccggaaaacaactataaaaccaccccgccggtgctgaaaagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcgcgcgcaacggcgatcattgcccgctgggcccgggccgctgctgccgcctgcataccgtgcgcgcgagcctggaagatctgggctgggcggattgggtgctgagcccgcgcgaagtgcaggtgaccatgtgcattggcgcgtgcccgagccagtttcgcgcggcgaacatgcatgcgcagattaaaaccagcctgcatcgcctgaaaccggataccgtgccggcgccgtgctgcgtgccggcgagctataacccgatggtgctgattcagaaaaccgataccggcgtgagcctgcagacctatgatgatctgctggcgaaagattgccattgcatt

SEQ ID NO: 150 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTCPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 151 - DNA, 651 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacacctgtcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 152 - DNA, 984 bp, Artificial Sequence
  source: /note="Description of Artificial Sequence: Synthetic polynucleotide"
gcgccggaactgctgggcggcccgagcgtgtttctgtttccgccgaaaccgaaagataccctgatgattagccgcaccccggaagtgacctgcgtggtggtggatgtgagccatgaagatccggaagtgaaatttaactggtatgtggatggcgtggaagtgcataacgcgaaaaccaaaccgcgcgaagaacagtatggcagcacctatcgcgtggtgagcgtgctgaccgtgctgcatcaggattggctgaacggcaaagaatataaatgcaaagtgagcaacaaagcgctgccggcgccgattgaaaaaaccattagcaaagcgaaaggccagccgcgcgaaccgcaggtgtatacctgcccgccgagccgcaaagaaatgaccaaaaaccaggtgagcctgacctgcctggtgaaaggcttttatccgagcgatattgcggtggaatgggaaagcaacggccagccggaaaacaactataaaaccaccccgccggtgctgaaaagcgatggcagcttttttctgtatagcaaactgaccgtggataaaagccgctggcagcagggcaacgtgtttagctgcagcgtgatgcatgaagcgctgcataaccattatacccagaaaagcctgagcctgagcccgggcgcgcgcgatggcgatcattgcccgctgggcccgggccgctgctgccgcctgcataccgtgcgcgcgagcctggaagatctgggctgggcggattgggtgctgagcccgcgcgaagtgcaggtgaccatgtgcattggcgcgtgcccgagccagtttcgcgcggcgaacatgcatgcgcagattaaaaccagcctgcatcgcctgaaaccggataccgtgccggcgccgtgctgcgtgccggcgagctataacccgatggtgctgattcagaaaaccgataccggcgtgagcctgcagacctatgatgatctgctggcgaaagattgccattgcatt

SEQ ID NO: 153 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTCPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 154 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 155 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 156 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 157 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 158 - DNA, 633 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 159 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 160 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 161 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 162 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 163 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 164 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 165 - DNA, 630 bp, Artificial Sequence
  source: /note="Description of Artificial Sequence: Synthetic polynucleotide"
ccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacaatagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtctccgggtaaa

SEQ ID NO: 166 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 167 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 168 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 169 - protein, 226 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 170 - DNA, 1005 bp, Artificial Sequence
  source: /note="Description of Artificial Sequence: Synthetic polynucleotide"
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 171 - protein, 335 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 172 - DNA, 681 bp, Artificial Sequence
  source: /note="Description of Artificial Sequence: Synthetic polynucleotide"
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 173 - DNA, 1014 bp, Artificial Sequence
  source: /note="Description of Artificial Sequence: Synthetic polynucleotide"
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 174 - protein, 338 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 175 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 176 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 177 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 178 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 179 - DNA, 633 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 180 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 181 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 182 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 183 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 184 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 185 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 186 - DNA, 630 bp, Artificial Sequence
  source: /note="Description of Artificial Sequence: Synthetic polynucleotide"
ccatccgtgttcctgtttcctccaaagccgaaggacaccctgatgatctcaagaactccggaagtgacttgcgtcgtcgtggacgtgtcacatgaggatccagaggtcaagttcaattggtatgtggacggagtggaagtgcataacgccaagaccaaaccccgcgaagaacagtacgggagcacctaccgcgtggtgagcgtccttactgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtctccgggtaaa

SEQ ID NO: 187 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgggagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 188 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 189 - protein, 113 aa, Artificial Sequence
  source: /note="Description of Artificial Sequence: Synthetic polypeptide"
MARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 190 - DNA, 342 bp, Artificial Sequence
  source: /note="Description of Artificial Sequence: Synthetic polynucleotide"
atggcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatataa

SEQ ID NO: 191 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 192 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 193 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 194 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 195 - DNA, 630 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 196 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 197 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 198 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 199 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 200 - DNA, 954 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 201 - protein, 318 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 202 - DNA, 630 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 203 - DNA, 963 bp, Artificial Sequence
  source: /note="Description of Artificial Sequence: Synthetic polynucleotide"
ccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 204 - protein, 321 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 205 - protein, 212 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 206 - protein, 211 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 207 - DNA, 960 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 208 - protein, 320 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 209 - DNA, 636 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 210 - DNA, 969 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 211 - protein, 323 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 212 - protein, 212 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 213 - protein, 211 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 214 - DNA, 960 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 215 - protein, 320 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 216 - DNA, 636 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 217 - DNA, 969 bp, Artificial Sequence
  source: /note="Description of Artificial Sequence: Synthetic polynucleotide"
ggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 218 - protein, 323 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 219 - protein, 211 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 220 - protein, 210 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 221 - DNA, 957 bp, Artificial Sequence
  source: /note="Description of Artificial Sequence: Synthetic polynucleotide"
ggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 222 - protein, 319 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 223 - DNA, 633 bp, Artificial Sequence
  source: /note="Description of Artificial Sequence: Synthetic polynucleotide"
ggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 224 - DNA, 1032 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 225 - protein, 322 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 226 - protein, 211 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 227 - protein, 210 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 228 - DNA, 1023 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 229 - protein, 319 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 230 - DNA, 633 bp, Artificial Sequence
  source: /note="Description of Artificial Sequence: Synthetic polynucleotide"
ggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 231 - DNA, 966 bp, Artificial Sequence
  source: /note="Description of Artificial Sequence: Synthetic polynucleotide"
ggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 232 - protein, 322 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 233 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 234 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 235 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 236 - protein, 216 aa, Artificial Sequence; identical to SEQ ID NO: 233
  source: /note="Description of Artificial Sequence: Synthetic polypeptide"

SEQ ID NO: 237 - DNA, 1044 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggatccggaggcggtggaagcggaggtggtggatctggaggcggtggaagcgcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 238 - protein, 348 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGSGGGGSGGGGSGGGGSARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 239 - DNA, 996 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgaccaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggaggtggtggagcgcgcaacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 240 - protein, 332 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 241 - DNA, 2145 bp, Artificial Sequence
  source: /note="Description of Artificial Sequence: Synthetic polynucleotide"
gatgcacacaagagtgaggttgctcatcgatttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgcggccagtcaggccgccttaggcttaggatccgccgctcaggctgcacagcaagcagcccaagcagctcagcagggaagcgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 242 - protein, 715 aa, Artificial Sequence
  source: /note="Description of Artificial Sequence: Synthetic polypeptide"
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGSAAQAAQQAAQAAQQGSARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 243 - protein, 339 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 244 - DNA, 1017 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 245 - protein, 231 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 246 - DNA, 693 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 247 - protein, 342 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 248 - DNA, 1026 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 249 - protein, 339 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 250 - DNA, 1017 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 251 - protein, 231 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 252 - DNA, 693 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 253 - protein, 342 aa, Artificial Sequence
  source: /note="Description of Artificial Sequence: Synthetic polypeptide"
MEWSWVFLFFLSVTTGVHSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 254 - DNA, 1026 bp, Artificial Sequence
  source: /note="Description of Artificial Sequence: Synthetic polynucleotide"
atggaatggagctgggtctttctcttcttcctgtcagtaacgactggtgtccactccggtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 255 - protein, 341 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 256 - DNA, 1023 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 257 - protein, 233 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 258 - DNA, 699 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 259 - protein, 344 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 260 - DNA, 1032 bp, Artificial Sequence; identical to SEQ ID NO: 224
  source: /note="Description of Artificial Sequence: Synthetic polynucleotide"

SEQ ID NO: 261 - protein, 341 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 262 - DNA, 1023 bp, Artificial Sequence; identical to SEQ ID NO: 228
  source: /note="Description of Artificial Sequence: Synthetic polynucleotide"

SEQ ID NO: 263 - protein, 233 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 264 - DNA, 699 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 265 - protein, 344 aa, Artificial Sequence
  source: /note="Description of Artificial Sequence: Synthetic polypeptide"
MDMRVPAQLLGLLLLWLRGARCGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 266 - DNA, 1032 bp, Artificial Sequence
  source: /note="Description of Artificial Sequence: Synthetic polynucleotide"
atggacatgagggtgcccgctcagctcctggggctcctgctgctgtggctgagaggtgcgcgctgtggcccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 267 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 268 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 269 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 270 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 271 - DNA, 651 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 272 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 273 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 274 - protein, 217 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 275 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 276 - protein, 325 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 277 - DNA, 975 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 278 - DNA, 651 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtgctccaccaggactggcttaatgggaaggaatacaagtgtaaggtgtccaacaaggccctccccgctcccatcgaaaagaccatctcaaaggcaaaggggcaaccaagggaacctcaagtgtacaccctgcctccgtgcaggaaggagatgaccaagaaccaggtcagcctgacttgtctcgtgaagggcttctatcccagcgatattgctgtggaatgggagtcaaatggccagcccgagaataactacaaaactaccccacccgtgctgaaatctgatgggtccttcttcctttactccaagctgaccgtggacaagagccgctggcaacaaggcaatgtctttagctgctcagtgatgcatgaggctctccataatcactacactcagaagtcactgtccctgtctccgggtaaa

SEQ ID NO: 279 - protein, 328 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVCTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGARDGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 280 - DNA, 984 bp, Artificial Sequence
  source: /note="Description of Artificial Sequence: Synthetic polynucleotide"
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataattgcaagacaaagccgcgggaggagcagtacggcagcacgtaccgtgtggtcagcgtctgcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtgcgcgcgacggagaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcata

SEQ ID NO: 281 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 282 - protein, 216 aa, Artificial Sequence; identical to SEQ ID NO: 48
  source: /note="Description of Artificial Sequence: Synthetic polypeptide"

SEQ ID NO: 283 - protein, 216 aa, Artificial Sequence; identical to SEQ ID NO: 38
  source: /note="Description of Artificial Sequence: Synthetic polypeptide"

SEQ ID NO: 284 - protein, 216 aa, Artificial Sequence; identical to SEQ ID NO: 91
  source: /note="Description of Artificial Sequence: Synthetic polypeptide"

SEQ ID NO: 285 - protein, 216 aa, Artificial Sequence; identical to SEQ ID NO: 85
  source: /note="Description of Artificial Sequence: Synthetic polypeptide"

SEQ ID NO: 286 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTCPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 287 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 288 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 289 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTCPPSREEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 290 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 291 - protein, 216 aa, Artificial Sequence
  source: /note="Description of Artificial Sequence: Synthetic polypeptide"
APELLGGPSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 292 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 293 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 294 - protein, 226 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 295 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 296 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 297 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 298 - protein, 209 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNCKTKPREEQYGSTYRVVSVCTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 299 - protein, 211 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 300 - protein, 211 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 301 - protein, 210 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 302 - protein, 210 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 303 - protein, 212 aa, Artificial Sequence
  source: /note="Description of Artificial Sequence: Synthetic polypeptide"
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 211 aa, Artificial Sequence
  source: /note="Description of Artificial Sequence: Synthetic polypeptide"
GPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 210 aa, Artificial Sequence
  source: /note="Description of Artificial Sequence: Synthetic polypeptide"
PSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. A fusion protein comprising a GDF15 region and an Fc domain, wherein the Fc domain has the amino acid sequence of SEQ ID NO: 220 or SEQ ID NO: 220 with a tyrosine to cysteine mutation at position 113.

2. The fusion protein of claim 1, wherein the GDF15 region comprises the amino acid sequence of SEQ ID NO: 4, 8, 12, 25, 52 or 55.

3. The fusion protein of claim 1, wherein the GDF15 region and the Fc domain are joined by a polypeptide linker.

4. The fusion protein of claim 3, wherein the polypeptide linker comprises the amino acid sequence of SEQ ID NO: 18, 30, 34, 40, 58, 61, 64, 69, 72, 75, 78, 113, 116, 119, 122, 125, or 128.

5. The fusion protein of claim 1, wherein the fusion protein comprises the amino acid sequence of SEQ ID NO: 222, 225, 229, or 232.

6. The fusion protein of claim 1, wherein the fusion protein comprises two or more Fc domains.

7. A dimer comprising (i) a first polypeptide chain comprising a GDF15 region and a first Fc domain, wherein the Fc domain comprises the amino acid sequence of SEQ ID NO: 220 or SEQ ID NO: 220 with a tyrosine to cysteine mutation at position 113 and (ii) a second polypeptide chain comprising a second Fc domain.

8. The dimer of claim 7, wherein second Fc domain comprises the amino acid sequence of SEQ ID NO: 16, 22, 28, 29, 33, 35, 38, 48, 85, 91, 106, 132, 141, 148, 155, 162, 169, 176, 183, 192, 199, 206, 213, 220, 227, 233, 236, 268, 275, 281, 282, 283, 284, 285, 286, 287, 288, 289, 290, 291, 292, 293, 294, 295, 296, 297, 298, 299, 300, 301 or 302.

9. The dimer of claim 7, wherein the GDF15 region comprises the amino acid sequence of SEQ ID NO: 4, 8, 12, 25, 52 and 55.

10. The dimer of claim 7, wherein the GDF15 region and the first Fc domain are joined by a polypeptide linker.

11. The dimer of 10, wherein the polypeptide linker comprises the amino acid sequence of SEQ ID NO: 18, 30, 34, 40, 58, 61, 64, 69, 72, 75, 78, 113, 116, 119, 122, 125, or 128.

12. The dimer of claim 7, wherein the first polypeptide comprises the amino acid sequence of SEQ ID NO: 222, 225, 229, or 232.

13. The dimer of claim 7, wherein the first and second polypeptide chains are non-covalently associated.

14. The dimer of claim 7, wherein the first and second polypeptide chains are covalently associated.

15. The dimer of claim 14, wherein the first and second polypeptide chains are covalently associated via disulfide bonds between their respective Fc domains.

16. A tetramer comprising (i) a first dimer and (ii) a second dimer, wherein the first and second dimer independently comprise a dimer comprising (a) a first polypeptide chain comprising a GDF15 region and a first Fc domain, wherein the first Fc domain comprises the amino acid sequence of SEQ ID NO: 220 or SEQ ID NO: 220 with a tyrosine to cysteine mutation at position 113, and (b) a second polypeptide chain comprising a second Fc domain, and wherein the first polypeptide chain of the first dimer is linked to the first polypeptide chain of the second dimer via an interchain disulfide bond between their respective GDF15 regions.

17. The tetramer of claim 16, wherein the second Fc domain of the first dimer, of the second dimer, or of both the first and second dimers comprise the amino acid sequence of SEQ ID NO: 16, 22, 28, 29, 33, 35, 38, 48, 85, 91, 106, 132, 141, 148, 155, 162, 169, 176, 183, 192, 199, 206, 213, 220, 227, 233, 236, 268, 275, 281, 282, 283, 284, 285, 286, 287, 288, 289, 290, 291, 292, 293, 294, 295, 296, 297, 298, 299, 300, 301 or 302.

18. The tetramer of claim 16, wherein the GDF15 region of the first polypeptide chain of the first dimer comprises the amino acid sequence of SEQ ID NO: 4, 8, 12, 25, 52 or 55.

19. The tetramer of claim 16, wherein the GDF15 region and the first Fc domain of the first dimer, of the second dimer, or of both the first and second dimers are joined by a polypeptide linker.

20. The tetramer of claim 19, wherein the polypeptide linker comprises the amino acid sequence of SEQ ID NO: 18, 30, 34, 40, 58, 61, 64, 69, 72, 75, 78, 113, 116, 119, 122, 125, or 128.

21. The tetramer of claim 16, wherein the first polypeptide of the first dimer comprises the amino acid sequence of SEQ ID NO: 222, 225, 229, or 232.

22. The tetramer of claim 16, wherein first polypeptide of the second dimer comprises the amino acid sequence of SEQ ID NO: 222, 225, 229, or 232.

23. The fusion protein of claim 1, wherein the GDF15 region comprises an amino acid sequence that is at least about 85 percent identical to SEQ ID NO: 4, 8, or 12.

24. The fusion protein of claim 23, wherein the GDF15 region comprises an amino acid sequence that is at least about 85 percent identical to SEQ ID NO: 12 and comprises a mutation at position 3.

25. The fusion protein of claim 24, wherein the mutation at position 3 is a N3Q mutation.

26. The fusion protein of claim 25, wherein the GDF15 region and the Fc domain are joined by a polypeptide linker.

27. The fusion protein of claim 26, wherein the polypeptide linker comprises the amino acid sequence of SEQ ID NO: 18, 30, 34, 40, 58, 61, 64, 69, 72, 75, 78, 113, 116, 119, 122, 125, or 128.

* * * * *